United States Patent 12,491,220 (COMPOSITIONS CONTAINING INDOLE-DERIVED METABOLITES AND METHODS OF USE THEREOF) - sequence listing, part 5

SEQ ID NO: 10 - DNA, 3704609 bp, Bacillus pumilus (residues 1,852,306-3,704,609 of 3,704,609)
  source 1..3704609: mol_type = genomic DNA
tataccgtaataatgagggagacttgaaaggaagtaatggaaagtgtcttttctatctgtggcaatacgggaatgagcatcgagttcccaagtgtcatgattaaaggcactgatgataatgcaataatattctttttactaactgttttctcgcccaacatcattcacccaattctatatactgttacgtattagtgtggcaagttttacgggtattatgtatgggcaaacaaaaagcaaccgcttatgaaagcgactgctcgttaaaatcgtttacgtatcacatgaaagctgaatttatccgctcgaaaataatttagtgagtataagaccggctgatcatcctgatcatagtgcatttgtttcaataataataatgctgtttcaggatcacattctagtatcggtgaaacctgatcgtggtagccgattggttcaatgtcagcaactgcatatttaatcccgctgtgtggttctcttccaaacagctcaaaaagagactcttcttcatgtgtaaaagaagcaggaagatgcttaaccggaattttatctaaacagtaaaccactggctgtccatctgccgttcgaacgcgctccattgaaaaaatctcatcagattcatcacactgaaaacgaatcacatcattctctgttggctccccttcttgggaggataaaaagatggtaccaggcgtcatattgacctgctctatcattttcgtgacacttgccagctgttctatgcctgttgaaaagagtggtcttgtgttgacgaacgtacccacaccatgccttctaattaaatatttctcttcttctaatatacgaagggcttcacgcagtgtcgctctgctcacgcctaaaagctttgagagctcaaattcagaaggcagtttctctttttcggcatatacgcctgtttgtatatcttctttaatacggtcaatcactttcaaatataaatggcgattgtctgttttggtcgacatgttttccctccgtctaatcaatgcaaatgataagatgagaaatctctattccgagataagttgaacataactatatcatgtttttgcaaataaataaatagtctgacttccagttaacataatcatactatcgttcacttcttttttagaaagctctcttcgatttatgaagagagctcgtcatattgttcttttgaaagcaggacttctctcggtttacttccttcataaggaccaacaacgccccgctcttccattgcgtcaatcaggcgagcggcccgggtatagccgatacggaatcttctttgaagcatagagacagaagccgtctgcatgccgatgatgagttccactgcttcatcatataaatcgtcatccacagatgtaagctgttcctgcgtttcttcagttggaatcatttcttcttgatattgcgctttttgctgagtgatcacatgatcaacgacatgctccacttcttcatctgataaaaaggcgccctgcacacgaacaggtttgtttgcaccaactggcagaaacagcatgtcccctctgccgagcagtttttctgcgccccccatatcaaggatcgtccttgaatcagtttgtgaggacacgctaaaggcgatgcgagatgggatgttggctttaatgacacctgtaatgacatcgacagaaggtctttgtgtggcgataattaaatgaatcccagctgcacgagccatttgcgaaagtcttgtaatggaatcctccacatctgaggaagcgaccatcattaaatctgcaagctcgtctacaatgacgacaatataaggaagttctggctgtttcgcctcttctgattgattcattcttttaatgtaatcattgtatccttcaatgtttcttgtccccgtatgagaaaataattcatatcggcgttccatttcactgacgacttttttcagtgcctgtgaggcttttttagggtccgttacaacgggagcgagcagatgcggaatgccattatacacatttagttcaaccattttcggatcaatcatcatcatttttacttcatgaggtttcgctctcatgagaatactcgtgataatgccattaatgcacacactttttccgcttcctgtcgatcctgctacaagtaaatgcggcattttgttcatttcagcgagcacggcttcacccgaaatattgcggccgagtccaatcagcagcttcgcatttggacggtcattttgcttcgattctaatacctcttttaaagaaaccatcgcaatttctgcattaggaacctcaatcccaatggctgatttcccaggaatcggcgcctcaatccgaatatcttttgctgcaagagcaagggctaagtcatcacttaaattgacgattttacttaccttcacgccaacatcgggatagacttcatatttggtgacggctggtcctaagtgaacctgtgtgacttttgcttttacgccgaagctttgaaacgttttttcaagctttcttgcattttcatatatattcttcttgtctgtttgctgtcctgagtgctgcggctctgccaaaatatccagtgacggcaattcgtaatctttgttttcaagttccgtaaacgtcatcggcggcgcctcttttggttcatcagctgaatctgatggagcaggcgcactttgcacagattcttgaagaggcgaagtctcttttgccgcctgctctttttgaacgagcggggtgagaatgtcatctctatctgcaaagcttgagataatcggctgactattgtcaggcaccgctgcttcctcttcaactaaaatctgatcatcttcgtcctcttcctgaatacgagaccgttttttcttttcggccgttttctgagagggcacgctctttttcgcctgccggattcctttcatatcttcaacaaacgctttccattgcttcaccataaattgcgagacaggcagcgtcacttttttcaccatttcttgaagagatcgatttgtaatcagcacaattccaatcagcatcagaacgattgccatgatttgagagcctgcttgtgcaaataagaaataagaagcagcaaataatacggcaccgatcatgccgcctcctaaatcaggcgaccccgtctcacctttcatgtccatcaagaaaagctcaaatgtatttctgatcacactttgagagcctaccgcacctgcagatgagaggtgctgaaagagcttcacatgagacaaaagcaagatactcgcaatgatgcagtatagccctgcctttctccttgtcaacatatctggaatttgttttttccagaagatggtcacgccaaaaagaaataatccgataaggcagagaatgaaccattcgcctgcaaaaaatcggaataaatatacgaaggtttgtccaacgacgcctagctgtaaaatggcaatgatcgctatggcaatacagactaacccatttaattcatatttcagttttagctgtttattttgtttttttctcgttttccgttttctttttttagccatactcatcaccttactacgaaagaaaatataacctaccgaaagatcagaaagaaagcagcctggttttggctgcatcttgttgtaagttttccctttattatagcatagaatcattcatatgagtcggtttgattggagcctaattgtaacttcaatcgcttgcctggtgcaagctcttgattcagaaaatccattggattggtactcatgacttgaacgatttctgcttcatcctctttcatttcaaccataactggcacgccttggatggttacctgctgaagtttgcggtctccttgctcctccgcgtaaatggcttcatatggcataggtgtgtataaaatcattggatcatcccctcgttttgagatgccctttctccaatcagctcattcaactttttaatcgcttgtcctacaccgcctacttcattcatgagtccgtatgctgctgcctcatgaccaacaacatttgttccaatgtctcttgtcaaattgccttttgagaacatgagctctttgaacttctcttctgtaatattggagtggcttgtcacaaagttaatgactctttcctgcattttatctaagtattcaaatgtttgcgggacaccaatgacaagaccagttaagcgcacaggatgaatggtcatcgtggctgtttccgcaatataggaatagtcacacgatacagcaatcgggacaccaatggagtggccgccgccaagtacaatcgatacagtcggttttgatagagacgcaagcatttctgcaatcgctagccccgcttcaacatcgccgcctactgtatttaagatgatcaaaagaccttcaatttttgggttttgctctactgctacgatttgcggaatgacatgttcgtatttggtggttttattttgtggtggaagctgcatgtggccttcaatttgtccaataatggtaaggcaatggatatttgtatcttgcggcagctgtggtatagctgtttcaccaagctgctgtattttgctcattatgctgtctttttcttctggctttcgctcaggctgctgttcatttttttcgtccatttgtctccatcctttcctcaaactctcctcctattatgaacaagaaggccgtattcaatccgtattcctcgcacgacatcaaaaaagcccaaagagcttatgctccttgggctttctcatcacacttccataataattggaatgatcatcggcttacgttttgttttttcatataggaattgattaagtacgtcacgcatggattgtttcaatgttgaccattcaacaattgagttttccgtttgctctttgacaattcctttgaccatttctgtcgctttcacaatcagctcttcagactctctgacatacacaaatcctcttgtgatgatttcaggtccagaaattaattgtttcttttgtttatcgagcgtaatgacgacaattaagataccgtcttgagacaataaacgtctatcgcgtaacacaatgttaccaatatcaccaacgcccagaccatcgatcaaaatattgccttggtgaactttttcaccgatcttgacgttctgtcctctaaactccacaacatctcctttatcaatcaagaaaatgtcacttcgtttcattcccacttcttcagcaatacgagaatgtgctttttgcatacgatattcgccattcaccggaattaaatacttcggcttgagtaagttcagcatgagctttaactcttcttggcagccgtgtccagagacatgtacacgtttttgcgcaaaaatgacttgtgcgccgcttcttgtaaggaaatcaactgtttttgaataggtgagttcttgtccaggaagaggtgtagatgcaatcacaaccgtgtcatctttttcaatatgaagctgtttgtgattttgtttcgccatttttgttaacgcagcaagaggctctccgtggcttccagctgtcaggatgaccacatcgtttttcgccattttcttcacttcttgaactggtacaaataattcttcgtctgctgtgacataaccaagtttgatcgccagctgaagagtcgtcatcatattctttcctgctacggcaagcttacggccattttgatttgttgcattaatgatctgctgcactcggttaatgttagatgaagatacagccacaatgacacgattttcagtattgtacatcgcatttgagatttcgtcttggacgagcgcctcagaaggtgtataacctggtttttcagcattggcactgtctgaaagaagtgctaaaacgccattgtttcctattttcgcaatctctcctatgtcacaggcttggttaagcgctggggtttgatcaaatttaaaatcacctgtgcatacgattgaaccaagagaggttttgaagctgatcccaactgaatcagggatgctgtgattcgttctaaagaatgatacctttgttgtttcaaacgtaatgactgattttgcatgtacctcacgcaagtcagctttttgattgaagccatactgttttaatttttctcgaagtaacgcaagggtcagcttcgttccgtaaactggtacagacaatttgcttaagcaatggaatacgcctccgattgcttcatcatgtccgtgggtaagaaaaattgctttcacccgatcagcacgttctgttaaataagagatatcaggaatgacgacgtcaatgcctagcatttcgttttccggatgcatcaagcctgcatccaccacatatatgtcggaatcaatttcaatgacatataagtttttcccgatttctccaacgcctccaagtgcaataattcttacgttctctgtatttttctttttcaaaattcttatcctcctagtctcaagcccgtccatcatcgcttaatgctattataactgaatctaattttagaaaacaagatgaagtcacattttaagaaagtgtttatgtataaaaaacggtcatactcagggacatctgagaatgaccgcttacgaaatcttttgttttgatcagctgtttaaaacgctgcttaaatccagtctctcttcttctgacaaaggtagaagcggaagtcgaaccgatccgacatctagtccttttagctgaagagctgttttaacaggcgttggatttggcgctgagaatagctgtttcatgattgggagcagcttttgatggatcaaagcggcattggccgtttgacctgaagcatagcttttcagcatttcctgcatatcaagccctacgatatgagacgcaacagagactactccttttgcaccaacagatacagcaggaagtgttaagctgtcgtcacctgaataaacatcgaaatcttctggtgtctctgcaatgatttttgtcatagcatcaagatcaccacttgcttctttgatagcgacgatgttaggtatttgcgcaagcttaatggttgtttctggggctaatgacgcaaccgttctccctggtacattgtaaagcatgacaggaagagatgtagactcggcaatggctttaaagtgtgcatacatgccttcctgtgatggcttgttgtagtaaggtacgacaagcatcactgcatcaacgcccgcttcttctgcttttttcgttagtttgatagacgcatttgtattattactgcctgttcctgcaatgattttacaacgaccatttgctaattttaccgattgctgaaaaagagcgactttttcttcagtcgataaagttggcgattcgcctgttgtccctgcaacgactaacgagtcactgccgttttttaacaagtaatcaatgagaattgatagcttttggaaatcaatgttgccctttttatcaaaaggtgtaatcatagctgttgcgatatttccgaaattcatttttttcacctcatcatgattcaatcacatttatcttgaaagttcaaacacttcgtgcagggcattgacagccgctctcatgttttcttcgttcactagcacccaaatggtcgtatggctgtcagccgattgtaaaatcggaatgttttgctcggatagagccgatacaattttagatgtgacacctggtacacccatgatgcctgcgccaacagctgatactttcgcacaatttgttgtgacaattggcgtatagccaagatcttttaggatcgaggttgccttttcagtcattgtacctgtcacggtatacacaatctcactcggcgtaatgttgaagaaatcgacactgatttgtgcattagccattgctttaaagacctctgtttggacgctgtactgcccttcttttgctgggactttgatttgcgtcacatcattgacatgtgcaatacccgtaatgaggcggtcatacacatcatggctcattttatctgagtagtgtgatgtgacgagtgtgccctcttcatcagagtatgttgaacggaccctcattggtacttttgcttgcatcgcaatttcgacagctctcgggtgaatgacttttgctccttgatatgcaaggttgcaaatttctgtataagtcacgactctgagcggctttgcattttcaacaatgcggggatctgccgtcatcacgccttctacatctgtaaaaatatcaataaagtctgcctgcaatgcagcacctaaagcagctgcggacgtatcactgccgcctcgtccgattgtggtcacgtccccatttttcgcagctccttggaacccagcaacaacgacaacatcatgttcagacagtgccgcctcgagacgctcacacttcatatcaataattttcgcactcgtatgctccttatctgtcacaaagccagcctgtgcgcctgtcatcgctacagcttttagcccgttttcattcagcatacttgaaaacacaacagctgaaatattctctccgcaggaaacgagcaagtctttttctcgatttgtcatgtgctgcgcgctgccataaagcagaccaagcagcgtatctgtcgcataaggatcaccttttcgtcccattgcggaaacgacgacaaccgacttatagcctttctcttttgccgataagatatgtgcaagtgccctttttctaccttgatcatctttgacagatgtaccgccaaatttttggacaattattttcactgtcttcactccaagttcattctgacgtaacagaagagagcaggcgaaagatgcctaactctcttctgttcgtcctcatcatccattgaatgttaaactaattttaatgcttttaagctttctgcaatttgaacggagttccatgcagcgccttttagcaggttatcagatacaatccacatatggaacccgtttggacggtccaaatctttccgaatgcggccgacaaatacgtcgtttttcccaacagcatctgcaggcattggataaatttgctgagacggatcatcttgcaatgtaatgcctggagcatcttttagaacggacttgatgtcgtcaactgttgcgtcgtttgattctagttcgacgtaaacagattctgaatgtcctgtttcaattggaagtctcacacatgttgccgctacttccagctctggcatatgcatgatttttttcgtttcgttgatcattttcatttcttcaaatgtataaccattgtcttggaatttatcaatttgcggaatcgcattaaatgcaatttgataaggcatgacttccggcttcacatcttctttatttaaaatggcttgtgattggctgtatagctcgtcaatggcttcatgtcctgcacctgatacggcttggtaagtggacacgatgacttttttcatgccatacgcctgacgaagcggttctaatgccgctaccatttgaatcgttgaacagttagggtttgcaatgattccttgatggtcatgcaagtctttttcgtttacctctggtacgacaagagggatgttttcgtccatacggaaagcacttgtgttgtctacaacaatcgcacctcgtttgaccgcttcaggagctagcgccttggaaacatttcctccagcactgaataatgcaatgtttactccttcaaagctttcaggtgttgcttcctgtacgatatactcttgacctctgaatgtcacttttgttccagcagaacgttttgaggatagtagagtcagtgtatccatttcaaaatctctgtcagctagtgtttttaacatttgttgaccgacagctccagtcgctccaactacagctacatgcaatcctcttcccatcagtaaaactccttccgacccatccatgattcttttctttcggatggccatcctatgactttttacattttattttaccatagaaaagcaaggcttgaagcatcttttttgaatctttcatgattttctagtaaatctattattcgtttggtccaattaaaatcggctgaatttgtctatgctgaagtgcctcttccactgtttgagaaagcagattcatgttcgcgaccatggaggtcggttttttaaatggatcatcttgaccaaatggaataaagaaaatattctttgtcgacatcaacctcatcagatttgtaccatttaagcctagcgcatcatttgttgaaattcctaaaacgacaggacgatgatttcgaatggttgcttttgcagccattaaaacagggctgtctgtcatggcatttgcgaatttcgccatcgagttcccagttaatggagcaatgaccatacaatcaagtggcagcttaggcccgagcggctctgctttcacaattgagtcaattgccttaaagccagtcagcttctcaatccgctcaatccagtccgccccatctccgaatcttgtattcgtgttctggaccgtatatgacaccactggacgcacttctgctccttcttttacaagtgcttcgatttgcggataaaccgcttcgtacgtacagtgggaaccagttaagccaaagccgattcttttcccttttaatgttgtcatgattccatcccccttttttcctctgcaagttcacataagagcccagaaagcacttttgcaatgatttgccctgctgtctttggcgcaacaattcccggaagtccaggtgcaagaagcgccttcactccgtgtttttgtgcaaagtcaaagtctgttcctcctgggcgggaggcaatatccaaaatgagtgtctttggtgtcatattgacgatgacagatgaatctaatacaaggcttggaatggtattgatgaggatatctacatccgttacttcttcttttaactggtccattgaaaatggatcgagtcccatttcaaaggaccgcgccaagtgagctgtatctgctgcccctacttttacgtccgcaccgagtgcccgaaatgtgcgggcaatggtgagtcctgttcttccgagcccgagaacagcaacacgtgatccatgaatcgtataatccgtttgctgaatggccatcatgataatcccttcaactgtaggaatagagttatatatggcaatatcatctcgctcaaacagcttcacaagttttcggttcacctgctttgccagattgtctaagtacgtattagaaatacctgagtacaaggtacaatgggcaggggttctttctaaatatgttgcttctagtaaaacctgctcatttgagaaaactgtcgcgacaacaccttcatccgttgcgcctgatactggcaggatcatactgtctacctgttcgaatggtagttctgacatttttagcttttcagccccaataaatccgtgatccagctgatcaaatccaaccaaaaacactttggcatgctgctgtgacagcttgcgaataatttcaagctgccttgcatctcccccgatcaccgcaaccgttaaaccgctcaacatactgaccgttcaccttctttatttaaaaaagtctgtaatattttctgaatctccctttcagcatatgaggagaggattcagcctgtgaacaaatcgaagagagaaaagaaaaagagcacccatttatgatggatgctctttttccccgggcggctgaagtgcttcaggcacatcgagaatgatcatatctgatcctattttttgaatgtgattccaggggacgcggatgtcatttccttgctttcgaaagccaaaccacttcaccgaaggtatgataagtgctgtgatttgaccgtcttgttcattgatttcaaggtcggtttgtccaagcacaccaagccgctccgctcttttgatatcgacaatctcttttcctgacagctcacttaacctcaaaatcgcatcacttcccttccgtatcatatatgcagccacaagaagaaatagaccgtcccgctttttcaagttatgaatgatgccaatttgaataccaagctggtttcagtagatgaaagtgatcatggtctgccagcattctctccactcggttcaccatatcttttacatgttcagtgtcataagaaagcgtccagacaatagaagaaaagcagctcattgctgtatagatagaaaaaagaagccaaaaatcgtctgtggcctgcgtacttacatagtaatccagttgcccagctgaaaacggaatactattttctcggctaaataaggacaatttataaaaatcatgaactgggtcaccccagtcagattgatcaaaatcaatgactcctgaatactcaccttcttgtatgatgatattccccaaatgaaaatcatcatgctggaattgattaggcctcgcctttactgcatcaacatgtgatttaataaaatctaatacgaaatgatcctgatcgaaggtcactccacttgattgataggcatgtacataccgttcatgtttcatcatgaccctctcatcccatgtcgcgatatgagaaggtgcgggacatgtgtgcatgaaactaagttctttgcctgcccgtctcccgatttcatactgctcttcatttgtaagcagatggatgaatgctctagcattctctccttcaataaaagagaaaatacgataggtacagttgagttcagtattcatcccaatctccatcacttcagaacatagaaggcctcgatctttaaacttttgctgaactgacgcttttcttttaaaattggaatacgttttgaggtttgatagcttgagcactagcttttcacttgaggatgttgtgacgagataagtacggtttccagaaaggccagatgtcattggctcaaaggaggtggcttgtgtcagaagcggagaaaggattttcagtttttcacgttccatgtaagcagcgcccctttcttcttgatatataataaacggcagacctcttaagaagcctgccgtgttgtttacattatgatggctgatcacccgtaggactaataagcgagagcgcataatcctctgtaaagattcgtttggataagttattcacaccttctaatgtgactttgttgatttcgtcaataatttcatcaagtgtgcgatgtttgccaaggagcagttcgtttttaccgtttcggctcatcttgctgtttgtgctttcaaggctgagcatcaggttccctttcatttgctccttagagttttcaagctctttttgcgtgattccctcacgctttaagacgtctagcgtttgtaagatggtttcagagagcaggtttaactgcttcgctccagtcccgccataaatcgtcagcatgccgttatctgcaaatgaactgtgatagctgaaaacagaataagcgagtcctttgtcttctcttacatcctggaacaagcggctgctcatgcttccgccaagaacattatttaagacgattaagtcatagatgcctttgtctccagctgggaggccattaaagcccaagcatagatgcgcttgctctgtttcctttttgcgtgtgagcttgtcatagtgaaattgcggcgcttctacaggctgtttttttcctttcgtttcatacgaaccgaacaacttttcaacttcactaatgaatgtgtcatccacattccctgcaacagagatgacgacgcggtccggcgtgtagaattcatccatataagctctaagagagtcaccgttaaaggtagaaagtgtttcttctgttcctaaaatcgggaagcctaaagaatgatcaccataaatcgctttgctcaacagatcatgaacgatatcatcaggtgtatcctcatacattttgatttcttcatatactacatttttttcttttttcaactcttcttcatcaaaagcagagtggaagaacatgtcgcttaatacatcgagggcgtagccagcatgtgaatcaagcacctttgcatagtagcaagtgtattcttttgacgtaaaggcattcacttgaccaccaatgcggtcaaaggattctgcgatatcacgtgcagatctcgtctttgttcctttaaagaacatatgctctagaaagtgtgagatcccgttaatttctggtgtctcatgtctagaaccagttccaatccagacgccaattgcgacagatcttacagtgggattgttttcaagtacaattcttactccgttttggcatgtatacgttttgaccaagttttgctcctcctattcaacaaacagatcggatcacggatgtcttttttcacttaggaggtcagaaaccgttcctaattcatatcctctttccttgatttgagtgataagtgcgtcaagacttttcgccgtcgaatctgttggatgcattaatatcatcgccccattgtgaattttcccaagcacccgtttttgtagtatatttggtgacggtttttgccagtcaatggtgtctaccgtccacataatggtttccattccttcttctgcagccagcttcactgtttcttctttgaaactgccgcttggaggggcgaaccatttcggtttttttccaagggattcttcaatttgacgattcgttttggtaatctgctctaatgctcgttctcttgtcagtgtgcgcatatcggggtgattgtatgaatggtttccaatttcatgaccatctgccacgatctttttagcaagatccgtgctttttttcacccatttgccttctaagaaaaaggtcgccttgacctgatgcttttccagtgtctttaacatcttgattaaatgctcgtcaccccaagccacgttgatgaggaaagcattcatttttttatctggatgtcctttgtaaatgggttcagcactaagttcatgtaaatgaatagtaggttttgtttcattgaaaacaagcagcttttcatcaaatgaccctcgttttttcattttttcataagaggcatcgatattgaccgtctgtccatttagaccaggcatctttttccacactttatcaatcttagcattttgcgccttcacttcatagtcagaagacttcgattcaatctcttgatataaaatatcttttgaaacagatgcaacctcagcatgctctttcattgattcaatatatgtaacagcagccggctgcttcatcgtttgatatgacacgagcagtaaaaatacaaacacaatgaacggtaacgtttttttcaatggttgtccctcccctttaccacaaattatgatagggagaaacaagctagaactattgttagcacaagaaaagaaagaagcctggtacggatacctggcttctaacatatttcattaagactgtttttcttctttttccttttcttcacgtaaaacagctttgcgagaaaggttcacacggccctgtttatcgatttcagtgactttgacaagtaattcatcgccaattttcacgacatcttctactttgcctacacgatcaagcgcaagctcagaaatatgaacaagtccatctttgccgctgaagatttcaaggaaagcaccgaatttttcaatgcgttttactttacctaagtaaagttgtcctacttcaacttctctcacaagatcttcaatgattttcttcgctttttggttcatatcttcttcagtagaagagataaagattgtaccatcttgttcaatatcgattttcacaccggtatcttcaatgattttgttaatttgtttaccgcttggtccaatgacatcgcgaattttatcaggattgattttcatcgttaagatttttggtgcataacgagacaattctcctctagaagcaggaatcgttgacagcatgctatctaagatttccattcttccttttttcgcttgttggagagcttcttccaaaatgtcttttgaaagaccatcgattttgatatccatttgaagtgctgttacaccttttgatgtacctgcaactttaaagtccatatctccaagtgcatcttccattccttgaatgtctgtcagcactgtgtagtattccccagatttcacaagtcccattgcaatgcctgcaactggtgctttaattggaacacccgcatccatcatcgcaagtgtgcttgcgcaaatacttgcttgtgaagtagaaccgtttgattctagtacctcagacacaaggcgaaccgtataagggaaatctttttcagatgggatcactggttctaatgcccgttcacctagtgctccatgtccgatttcacggcggcctgggccacgcattggacctgtctcaccaacactgaattgcgggaagttgtaatggtgcatgaagcgttttgattcttcaacgcctagaccgtcaagaatttgcacatcgccaagtgcacctaatgtacaaatactgagcgcctgtgtttgtcctcttgtaaatagacctgaaccgtgcgttcttggcagaagtcctacttctgaagaaagtggtcggatttgatctacaccgcgtccatctggacgtactttctcttcagtgatcagacgacgaacttcatttttgacaagcttgtttaatacgtctttcgcttgtttaattgtcgcttcgtcgcgatcttcttcttcaaatttctcaaccacagcttttttcacagcactgattgcatcttcacgtgcatgcttctcatgtacttgaatcgctttcagcaggtctgtttcagcaagtgcctttacttcgtctgctaacgtttgatctacttcatataaaggaatatcgatctttgctttaccgactgccttgacaatttcctcttggaattcgattaaacgtttgatctcttggtggccatacatgatagcttcaagcattgtttcttctggcacttcatcagcaccagcttcgaccatgttgatcgcatcttttgttccagcgactacaaggttgatgtcactttgttcaagctgttctacattgggattgatgataaactttccatcaactcgtcctactgtaacgccggcgattggtccctcaaatggaatgtcagacacacataatgctaatgatgagccaaacattgcagccatttcagatgaacaatcttgatccacactcatgacgatactaatcacttgtacttcgtttctaaatccatctgcaaataatggacggattggtctatcaattaagcggctcgcaaggatcgctttttcacttggacggccttctcttttaatgaagccaccaggaattttacctactgcgtacaatctttcttcgtagttcacagtgagcgggaagaaatcaagtggttttggttctttagaagctgttgctgagctaagcacagctgtatctccgtagcgtacgaggaccgctccgtttgcttgctttgcaagctggccagtttcaactgtcagttgacgtccagcccagtctatggtgaagacatgtttctcttgtcccattctgagaaaaactcctctcttatcttgaaattttagttaattcttattatgaacaaaatgattttcacatatcaatgtgaaaggtgtatgtagaagggtttttgccattctttcaacattttaaccataaaatattagtgattatacgataaaaaagcgggaatcctcccgctttttacgattatcgacgtaagcctagtttgttaattaactcacggtaacgagttacgtctttattacgtagatacgtaagaagattacgacgtctacctaccattttcaaaagaccgcgacgtgagtggtgatctttcttatgagtacgtaaatgctcgttcaagttgttaattgattctgttaggacagcgatctgaacttctggagatccagtatcagattcgtgtgttttgaactcactaattaattgagttttacgctcttgagtaatagccatcctgtttcacctccaaatcatgttagccccatctacctcgcaaccgtcggtgaagtcggcctgccaagtaagtggttttaaagctacaggaataatcatactaaaaatacgctgaatttgcaaatggtagagctgtttttctatgaattttttgtttgctttcgctgatgttgaaaaaactgaatcgcttcttctttatcttgactgatttgtgccgttaactcctggattccgttaaatttttgctcactgcgaatgcgcttgaaccactgtaatttaatcggttcaccatatatttcttcgttaaaatcaaagaggtttacttcaatagcaggctgatcagggcgtttttcataaaaggttggtttatagccaatgttacaaacaccgtcatacactttgccttttacttctgctcttactgcataaactcctgttggcggaatgatatattcagcagataaaccgacattggcagtcggaaagccgatcgtccgtcctcgcttatctccatgaatgacaataccgcgcagctgataaggttttcctaaaagctcacttacatattcaacatctccatttttcaatgcagagcgtatgagtgttgagctgacttttcggtcttgattggacaacttaggaacgatggtggccgaaatacgcccttttccgtactcatcgaaggtttccattgtgcctgcaccaaaacggccaaacgtaaaatcaaaaccagctactgcgtgctttacattcagctcatctaaatattgatcaacaaactcttgaggcgatagcgctgcaaagctttcgctgaactgcacaatgtataaatagtcagcgcccagctgttcgatgaaatcaattttatcctcaagcggcgtaattaagtccttgggttcacgtgctttttgcaaaacatgtgatgggtgcggatgaaaggtcatgactgctaaagccaaaccttcttttctcgcaatgttttttgctgcatcaatcactttttgatgtccgaggtgaacaccgtcaaaataccctaaagccataacagacgggtcttgatccttttgattcaatgtatgtgggtgtgaaatatgtatagtcttcacgagatggtcaccttttctttaagattgcttgtcctgagataagatcttcaccggcttcattagattctgtttggtcgggtgcttcatatatatcgccatacaccggcctgaaggagcaaagacagcgacacgatcttcctctgcgaaatgagcgaattcatcaggcattggcaggactgcaccgttttccactttacttgctaatgtatcatttatctcccatttcggcaaatgattgagcgcacgctctatcgggacaaggtgctcatctactgtaccttcttcgcttatatctcgcagctcatcaagggtgatgcactcatctagtgtaaaatcacctgatcctgtgcgaatgaggtgtgacatatgagctgggaatcctagtttctttccaatatcaaccgctaaggttctgacatatgttccttttgaacataaaacggtgaatctaaatgatacttttccattttcaaataaagcaggtgttgtccgctcgatacggtgaaccgtaatttcacggctcggtcgctcaatttcaatgccttctcttgcatattcatagagctttttcccgccaattttcactgccgaaaacataggtggaatttgttcaatggttccttgaaactgtttcagcacagcatcaatttcttcttctgagatgggattttgcacctttttttcttctacgatctcacctgtttggtcttctgttgttgtagaaaaaccaatcgtgatttctgcgtcatacgtttttgatttatctgttaagtattcgacaatcttcgttgctcttccgatacaaatgggcagaacacctgatacctcggggtcgagggtacctgtatgtcccactttttttgtatgcaggatctttctcactttgaacacacagtcgtgagaggtcatccctctttctttatgtaataaaagaacaccattgatcatctgcgctctctcctttcgtaaacgatgaaaaaggacagacgatcatcgcctatccttatttcaacgtcttattcatgatcttttgtgtttagttcagcaattaggctttcaattcggtttccgtaatccacggattcatcgaattcaaagtgcagttctggtgttttgcgaagtctaattcgattgccaatttcagaacggatataccctttagcctttgcaaggccttttaaggtttcctctctttttttctcgtcaccgagaacagaaatgtaaactttcgcaatttgcaaatcaccggatacttcgacatcggttacagtcaaaaagccgattcttggatcttttagctttctgcctaggatgtcgcctaattcctttttcatctgctcacccacgcgggttgctctcatactcatgatcttatcacctctaattaaaaccactcagttttcgtgatcgttcgttcaatttcaggaaaagaatcaataaagcttaaaacacgctgcaattccttttccacttgaacccgggatgaggaaattacggcgattccaattgatgtacgctgccatgtgtcctggtaatccatttcagctatggttacattgaatttatggcgcgttcttgtcaatatacgctgaagaaccgcacgtttttccttcagtgaggaggcatcataaatgatgcactcacattcggtataaccgatcattttctttcgatttcttgcataacgaatgattccatgacatcaccttcacggatatcattgtacttcttaatggtaataccacactcatagccttgtgaaacttctttcacgtcatctttgaatcgttttaatacgtcgacttcgccttcaaaaataacgacgccgtcacgaattaagcggataccactatctcttgtgatggttccttcagtgacataaccaccagcaattgtaccgattttagatactttgaacgtttgacgaacttcaacttgaccgatgactttttcttcatattcagggtcaagcattcctttcatcgccgcttcaatttcatcgatgactttataaataatgcggtgtaagcggatatctacgttttctgtttcagctgtgctcttcgcatttccatcaggacgtacgttaaatccgatcacgatcgcattagaagcacttgctaaaataatatcagattctgtaatcgctccaacacccgtatggatgattttcacttttacgccttctacttcaattttttgaagagcggccgtcagtgcttcagcagaaccttgtacgtctgctttcacgatcaagttgatatctttcacttcaccttgtttgatttgctcaaataggtcatctagagataatttcgctttgtctgaacgctgttcatcaagctgtttcgaagcacgcgcctcacctacttgacgagctgttttttcatctttgaacacgaggaactgatcccctgcattcggtacatcgtttaaaccagtgatttcaacaggtgtagatggtcctgctgttttcacgcggcgtccgatgtcattaaccattgcacgtacacggccaaatgtatttccgacaacgattgggtcacctacatgaagtgtaccagtttgaacaagaagggttgcaacagatcctcttcctttatcaagctcagcctcgatgacagtcccttttgccgcacgatttgggttggctttcagttctccaacttcgctgacaagaaggatcatttcaatcaattcatcaatgccttcacctgtttttgcagatagaggaacgaagatcgtttcgccgccccaagcttctggtactagaccatgctccgttaattcctgcatcacacggtccgggttcgctgttggtttgtcaattttattgacagcaacaatgattggcacttctgctgctttcgcatggttaatcgcttcaaccgtttgcggcataacgccatcatctgctgcaacaactagaatagttgtatccgttacctcggcaccacgtgcacgcatcgttgtaaaggctgcgtgtccaggtgtatcaaggaacgtgattttcttgccgttttcttcaatttggtatgcaccgatatgctgcgtgattccaccagcttcgccttcaacgactttcgtcttacgaatgctgtcaagaagcgttgttttcccgtggtcaacgtgtcccatgatcgtcacaactggagggcgtacttgcatatcttcttctttatcttcaacttcatacttttcaagttcagtttcttctaaaataatgacttcctctactggaacgccatattcagaagcgattaattcaactgtatctttatccagctcttggttaatggttgccataacaccaagcatcatcagctttttgataatttcagctgtttcttttccaagctcttcagccagctggccgactgacattgaatttgtaaattcaattttttcaggaagctctttcttaggcttcacaggtctagcttgctgatgctgcgatttgttatttccaccgcgtttatttttgtttttgttttggttgttgttttttttgtttttattaaattgattattctgcacgtcattcttctttctatcattgtttttgttagatgattgttttttttgttctgcgggtttctcgttagctgtctcttttgctttggcttttttatagatcgcgtctagctttttcacagtgtcgtcttcaagcgtcgccatgtggttgttcacttccacgttcatatccttaagcgctgctataatatctttacttgaaacatctatggcttttgcgtattcatatactctcactttagccattcgttcacccccaaataaattaatcgagcaagcttataagcttctttgcgaagccttggtcagtgacagcgacaactacgcgagcttctttcccaatagaacgtccgagaacggaacggtcttcaacttttctaaccggaacattataaaatttgcatttgtcagatacctttttctctgtgttcgatgaggcatctgctgcaagaagaaccagcttagcacgcgcatgtctaatttctttgatcacaagatcttctcctgacacgactttacgagctcgatttgctagaccaagcaaaggataccattcagattgagtcatttggttttttcaccttttcagctagttctagtaattcttcaaatatgtgttcgtcaatctgtgtctgaaattgctgctgtaaactgcgtttgttctttgccgcaagaatggtttctttatcgagagaaaggtaagctccgcgtccgttcttttttccggttgcgtcaacagacacttcaccttctttagaacgaacaacacggatcagttctttctttggtttcatttctcccgtcacgacacattttctaagcgggattttttttcggctattcaccttttacatcacctcttattcgtcagattcctcagctactggttcagcctctaagaaaagagattcagagtcttcagttcttgggaaaataccgagttcccttgcatctgtttcacttttaatgtcaattttccagctagtcagctttgctgcaagacgagcattttgacctcttttaccaatcgctaacgacagctgataatcagggacaatcactgttgtcgccttatcttcttcattcacaataacatcaagtacttttgatggacttaatgcattggcaacaaattcaaccgggtcattagaccaatggacaatgtcaattttttcgccttttagctcgttgacaattgcttgtacacgctgaccttttggtccaacacaagaaccaactgggtcaacatcaggatcatcagtacgaacagagattttagaacggtccccagcttctctagcaaccgatttaagctctacagtaccatcataaatttctggcacttcaatttcaaataaacgctttaaaagacctggatgtgttctagacacataaatttgtggtccttttgttgttttttcgacttttgtaataaacaccttaatgcggtcatgtggtttgtagtcctcatttggcatttgttcgttgaccggaagaagggcttcgattttgccaagtgacacgtaaatgaatttactgtcaattcgctgaacgattcccgtcataatgtcttcctcgcgatcgataaactcagtgtagatcacacctcgctctgcttctctcactcgctgcgtcaccacttgtttcgcagtctgagctgcaatgcgtccgaaatcttttggcgtgacttcaatttcaacgacgtcacctaccatgtaattcgggttcatattggctgcatcatctacagagatttcaagacgagaatcatacacttcatcgacaacatcttttcttgcaaatacgcgaattgttcccgtttcgcggtttaaatcaacacgaacattttgcgcttgattaaagttacgcttatatgcagaaatgagtgcagcttctatcgcttcaataataatttctttactaatacccttctctttctcgagaacagtcagggcatctaacaactcactactcatttttatggttcccccttatatcaatgaaaaggttaattgaacgaaactgctaatcttgcgttagctattttttcgtatggaatattgatctctttctttcttgtcttgatcttcactgtcactgttgcaatctcaccatcaaagcttgtaagctcaccttcaaatgctttttcaccatcaattggttcatatgttttcatgaaaacattttttccaagtgctttttcaaaatcagcttttttctttaatgggcgctccgctccaggagaggacacttcaagaaagtagttttggctaatcggatctgcctcatcaagcttttcgctcaaggcttcgctcactttggcacattcttcgatatcgacgcctttatcagagtcaataaacacgcgaaggaaccagttttgaccctctttgacaaattcaacatcaacgagttcaagctgtaagccatctaaaattggctgcaccatttcgcttacgacatccactacttttttgctcattctcttcctccttgtgctttcgataaacgctcttatcaatcattctgcataaaaaccctgctttatgtgagcagggggagcagaaaacggatgaataatgtcgagacaaaaattgcctgttcaatacaaaagagcgggtttccccactcttgtctcggtaatcgttagcatttccataaaaactataccatatccaatttttttatgcaaatgaagttccttattctgcaggcattcgtcatcggttcttttcgttcattcttttcgcatgttcactgataagtgctgcctccctgctaccttttatgatgcggaaaccgtcataatccggatagagcgaatcatcgtcctgaatgcttgttaaaatccaaaattgactgcctgcccctccgagccgctcaatcgctgacagccagctttcgtatacgtcaggacgtgctgattgattttgatagccaaattcctctaacacaactggttttccgattgacttcccgcgggtgatatggtcttcaatccatttcactccccagacagcagatttgctccaatgatctgggtacaggtgataggttccataatcgatattaggaagagccgtcaaacggtcccaatcgacgccttctccgcctccgtacaaccaatcttcatgccctggtatgcgaaagaatccttcatctcctactgcaacaagatggtgacgatccagcgatttgatccatttactcatttcatctgcccatttgactagtgcatttcccgttggatctgactgcacacgcggctcattggccaattcccaagtcataatagctggatcgtctttatattgaacacctgtatacgtattggttctttctaatacatagcgcacataatttttgtaagcatgttgaatacgaggatctgtataaaaggcatcatgcgttcctgccccgaaccactttacgtattgattcatcccgccaaagtcatcccaattgttcactagtggaatgacaagctttatctcttcctgtcctgctttataaatcgcataatctagtttttgaaaacctgattcttcatagatccctggactagattgtaaaacggagttttcttgaggggctccgtcgtgaaatccccaaatacgtatgacctttaaattcattgctttcatatcatcgaacactgcatctaccatctttttagatttgtaatgaaaatagtaattatttgtaccagcaaagtaaaatggttgattgttcagcgtaaattgtgtaccagatgtctgcacgtaagcggcggctttaatcgtaagtgaaaaccagccggcccatatagcgaccacaagtatgaagcaggacactctttgagtccactttttcattaacattctcctcacaatctatccttcttcaggtacgatcacatctagctgaagcggtgcttgttcatttgaatcaagttcaattgtctgctgtttcaacattttattttctttgccgattcgaatctcatatgttccatgaaatgctggacatatcacatggccattagcatctgttgtttcaactctttgggtcgtccactcatttagaagtttttcataacgtcgtcctgcttcatttaaagaccaatcataattcacgatagccgcatgctcacctctccaatgggcacctgcccaaaatccccacattagcactccttttacggctggatgactaaatgcgacgcgatataaagcctctaggttatccgctcttctattagcgtcagggtgaacagagtcatactctgtgacccatataggaagaccaagctcagcaagcacatcgagtctctctttgacaatgactggatcgacccgttcttcaaaatggccttgaaccccaatcgcttcaataggtgcgcctaactggcgcagttcattgatatgcgctttatacgcatggtgctcaccatatgagatcacattataatcattcacaaacaaaagtgctttcgggtcaatttttttcgtttcttcatacatccacttccaaatatttttcccaaagcgatctttaaaaaatgaaccgtgcatcatttcattgtttacatcccaatggcggaatcttcccttaaaatgattgcccgcatgctcaagccggtttttcatggcttcatatacttcgtgattcggcagtgacctcagccagcttggattcgcatcctctacctcccaaaataaagcgtgccccctcactggaagttgatgtcgatctgcaaaattcagcatcgcatctgctttttcataggtgactttccctctttgtggctcattcgcataccattttgcctcattttcaaaaacagcccaattaaaatacttcacgaaaaaatcagcatattgttgattaaataacacttggtcattcattgctgaaccaaatgcgaattcatgcctgatttgcttaatttcaacctctatacctgctattggctttttatcgccgtttgtcacgtttatcacaaggtctctttgtctatgctctgagattcgatcattcgcctcttttttccacatcagattgatctgctcattttcgcccttgttgaatgattgatgaagaaagcttctttctttgaccatgtaaaaatccccctatcttcattggatttatatttcttaatcaaactgccggctcaaagaaaccggcagcttaaattccgactgttagttgatcagacgatgatattctgcgtaggcagtggccatatccacttgtgaccagaaacggtgataagtgaaaaccggtgccccgttctcccatttgcctgttgcttcattaaatgaagactgatacttactctcaagtgaaggccatgctggatcttgtttaatgttcggacgaagatcagcaaaactcgtatagactccatttcctcctcgctgcggatcagaaggagtggtgctgcttccaggaatctgattcccttgaccaaatgtcccgttccaaccatttgggaaatacacttcttttttaaagaagcggtcatagtcctctctttcttcttctgttacaatgcccacgccatcattataattccacgccacctcaaggagctgtgcggctgcatctttcgctctgacaccaagcgctgtataatcccctgtttcaagctttgtagcagcagcaaagaaagttaatgccttgactaggctccctaatacgcccgtatcctgagttggatcttttgtgacagctgttaggtttggatttcctgttgcagactggaatccattccacgtgtcaggctgtccgctccaagcaatatttccaggaagccaaaactcgcctggtgcactcgttgcagccacagaaacatttgttccccctagaattctttgtccttggtcatttaagaaataaccctcttcatccgacacaggacggctgccgataaaaatgtaatcgagtgcatagttaacccattttgtgatacaggatttagccatttggacattttcagaagttttgtctccatctttcactaaaatataataaagctctgctacgcgctccatcggccatgcctgcatcccaaaccagttattagaaggcggatcatgataaacaggtgcatcctcgtatgccatatcgtaaaaagtacttcttcccgccggatatgcactatagtctccattccaactattggttgcacctcctgctatcgctccctcttttgattgaagccatacataaaattcaagctgcctttttaatgttttttcccaatcgcttgcaccagtagaggaagatggctttaaaccacctttgtctgaggacaaagcataagcggcgacagggttttgatacccttggtgacaatggctcgctccgatacgccatgaccagtttgcatagtcgccaagtcctccgccccaagaggtataccacgccattaagtaatgacaggcaccctttccgtttccagggtacggattcccttgcttaccgcttccaatcgtttgaaaatacttatcgtacataccgtaacggagaaaatcacccatttttttcgctttatcaagataggttgaattattgtagccgagttcctttgcccaatagattgcttgtattgcacgcgcatcagcatccgtcgcattggtataacgccactgagcagctggtacttgattttcttttgtgaacaagctcataaagccttcatttggcttcccaaacgatttatcatcttgtgatggatgcgggatcgcctcccatacagattcctgcggaccacgctggaacgtgttcacatatgcagctttatgtgatggattgagcaagttcccatatttataccagttatcgacatcaagcagccagtgcattaaatacgtttcatttgttccataggttgatttcaattcaccatcaatcggatcttgaccagcaggacgagctccgctcagctgactaggatattgatccggatatggtttttctgctgcgtaggtggctggactagaagggttgtaggcgctcatatgcggctgttcatcatttccatcttcatttactgggatgatgtatttctccatattgtcccaggctgcctctaatttgctccaatcccctgtgtaatgtccgtacaacacctctagccacagccaataactatatgcttctgacgttgtcatatgcccataatcaggcgcttcgcaaatgagcgtctcaattgaatgatacggaattccttctggtgaaaaatatccattcgcatcacttttaatttgatgataaagcgttaaaaaccgttctctgtttgacaaatccttcaccctttcaataaatcttgatttttatttgtctggaagtgtaccaaatactaaagaaccatcatcaaaaacaggtattctcggtgttttttgcatattggatgttaagccttgaaaggaataatcatttgaggcatcccatatattcgacccatttggcgcagataatcgaaattggatttcctttttatgctctgattctcctccaggaaaaatcgctacgccggtaaaatctatttctgcataatagacgtaagctgatgcgtcatataccttgagcggagaaaaggaagcgccttcattgtaggcggctgtcacttgaatatctttttcagtgaatccctttgcaaagacctcactcagattgacgtaatatctaaaggagagtgtttgactacttctcgccggccatccagaccggttgtatagaaccgccttgacttgagtagaagttgcatcattattcatcactgctgcctctacaaaaaactcatcctctggttgttctttaggcgggaaattgggtagctttgattgcctttttccaaacagctgcaccattttggctatatttcctgtaaaagcggcattatagtccgtcgccacctcgtttgatacataatcagagatgtcgtcatcatattgatcctgtgcattaggtccgccaacgagcgccccataaagagtgtgacgatgattcgaaggatttgtcagctggttagaccatgagccatgtgcagttcggtggtgcggatgcttcggcgggttctggccaaacccaacgacatagcttctattaagcggattatcaccaagcatatagtgagtttggttgatcgcaaacgtttggtatcgattctttttttcttcatctgacacccaatcagcgtagacaaaggctaaaaatgctgcatttgctgtataacgaagcgagccccattgatcaagccatgccaaaccgccaggcgtataagtgattctttcgacttttccattttgaacaaaacccgtcgtccagtaatcgagattacgctctgtcgattctatgaatcggttctctttcgtgattctggcgagtaagatttgcgaagcaaaaaaagtattgtcccacgacatggtaaacgtataatcccaatccttcggccattcctctactgcttttagtgcttgatttaaataggtttcttcatttgttgccaagtacagccagattccgccccatatgagttcatcaatatagccgctccatgaattgtaaaacggctgagcgtttgtgacacaatctgtatattcgccgcgataccggtcagcaaatgaataaagctgtttcgcgtgcgtcagaagctttgctgcataaggggcatctgtctctttaaaaatgatagaacccgctgctaaagctgccgcagtttgggcggccacttctgttccagggcaattttcatcaattttaaaagctggccggctcatcggcatcacttctgccggtccccaccaagcatgatcagcgttcccatcacctacctgcgcccaaaactcgttcggacctgtatgagcttttaaaaaataatctgttgcccacctgatctgatctaagatgtcatcaagcagttctgcctcttcataggcttctcggtattcatatactgtccaagcaagtacagctgctgagtaggccattggaaggccaaatttcacatgatcacctgcgtcgtaccagccgccagttaagtcatgccctacatccttcccatcctctagtccagaatctccccgccagttgagacggctgcttttaggcagctttccagaccgctgcgcttcataaaacaacaaggatttttgaagaacctctacatagttataagatgccatttccgtatgactcaccccttctttttagtcaaacatgaatacacaagccacctccttttattcagaacgtgatttgaacagctttgaaaagaatcaaatatgtttcaaaaataagcatagtaaacagcaatcagctttgtgctcatcgaagttgttttctcttgattctttctgtgactgtacccagaatgatcatatgtcgcatgagaacatttcagacggctaaattctcttttttgctctatttgggtagaaagaatgacatacaatctcttctcttaaaacatcacgctaaatcaaggtatatgaatgaattagaaaatgattccaattgatgggaattccttattagttaacataataatattattgtgtacataaaaaagaacgccctttataagggcgctcttcattggtcacattaaaacaaagaaagttggttttgatcaggaagtgcttctaagcagccttgacgatctaaatattctaggatcgttttcgacacttttccgcgtttttgtaaatcctcttttgaaaggaactccccatcttgacgtgcgcgcacaatatttaacgcaacgttcgttccgagaccagggattgagttgaatggcggaatcaatccgtcaccatcaatgataaactctgttgcacttgatcggtagaggtccacttttttgaaatgatagcctctttcacacatttcaagggcaagctctagtacagttaataggttcttttctttcggtgatgcatctaaaccttttgagttaatatcatccatgactgctcgaatcgcatttgatccttttgtcattgtttcaatatcaaagtcatctgcacgaacggtaaagtaagccgcatagtataaaagtgcatgatgcaccttaaagtaggcaatccgtacagccattaatacgtaagcagctgcgtgggccttagggaacatgtatttgatctttttacaagaatcaatataccagttcggaacattattattcttcatttcttcttcccattcaggaggaagtccttttcctttacgaacagactccatgattttaaaggcaagtgacggctctaagccctgatagatgagatagaccataatatcgtcacggcacccaatcacttcacttagttcacacgttttattgtggatgagctcttgcgcgtttccgagccatacatctgttccgtgtgataatccagagatctgaacgagctctgagaaggttgttggttttgtatcctcaagcatttgccgaacgaaccttgtcccaaactccggaataccgagtgtacctgttttacagccaatttgctcctctgttacaccaagaggctctgttccttggaaaattttcatcacttcaggatcatctgttggaatcgtttttggatcaattccgcttaaatcctgaagcatacgaataaccgtaggatcatcgtgccctagtatatcaagcttgagcaagttgtcatggattgaatggaagtcaaaatgcgtcgttttccaatcagaacctgtcgcatctgctggaaattgaataggtgagaaatcgtaaatgtccatataatccggtactacaataataccgcctggatgctggcccgttgtccgttttacccctgtacagccttgtacaagccggtcgatttctgcgcccctcatatgaagattatgatctccagcgtagcctttcacgtaaccgtatgctgttttttctgcaacagtaccaatcgtacctgctcggtatacgtactcttcaccgaacagctctttcgtatagttatgggcaatcggctgatattcacctgagaagttcaagtcgatatcagggactttgtctcctttaaaacctaagaacgtttcaaacggaatatcgtgcccatcttttttgtacggcgtgccgcattccgggcagtctttgtcaggaaggtcaaagcctgaaccaacagatccgtcgttaaagaattcggaatgcttacagcttggacatacataatgcggcgcaagcgggttcacttcggtaatctctgttaaagtggcaacaagagatgagccgacagacccccttgaaccaacaagatatccatcatcaagtgatttctttacgagcttgtgagagattaagtaaataacagcgaagccatgaccgataatactttttaattctttctcaatgcggtcttctacgattttcggcaggtcatctccatagatgctgcgcgccatttgatagctcatttcccgtatttcttcatctgcaccttcaatttttggtgtgtataggtcgtctttgattggtttaatgctttcgaccatctcagagactttttttgtattcgtcacgacgatctctttcgctttttcctctcctagaaaggagaatgcttcaagcatttcatctgtcgttctaaaatgaacttttggcagttcatgacggttcagcggatttgctccgccttgtgatgaaattaagattttacgataaattttgtcttctggatgcagataatgcacatttccagttgccacgactggtttattcagcttttcgccaagcttcacaatgtttgtgatgatttcttttaacgcacgttcatctcgaacaagctccagctgcagcagatgctgatacacttctggcggatgaacttctaaatagtcgtaaaatgctgcaatgtcttccacctcatcaggtgatttttgcatcatcccttcaaacacttcacccttatcacaggcagacccgattattaaaccttctcgatatttctcaagctgtgagcgcggaatgcgcggcacccggtagaaataatgaatatgagaaagagaaacaagcttgaataaatttttcagccctgtttcattttgtgcgatcagaatggcatggtaaggacgtgagcgctggtaagcattagactgacccatgttttcattcaattgatcgtgataggcaatatccttttcagccgcatcttttagcatttttagcatgagatagcctgtcgcctctgcatcgtaaatggcgcggtgatgctgcgttagttctatatcgaactttttacaaagtgtgttcagccggtgattcttaaattcagggtaaaggaaccggccaagttcaagtgtatcaatcacagggtttgacgctttatctgtttttaacaggcgtttgtacgctgtatttaaaaagcccatatcaaagcttgcattgtgcgcaacaaggatatcttgtccaatccattctttgaaatcccgtacgacatcgacgacatccggagcatctctgaccatatcatccgtgatacctgttaattcgatcgttgtcgctgataatgggtgatgaggatttgcaaatgcctcaaaacggtcaatgatttctccgccctttattttcactgctgccagctcaatgatcgtgtcataaacagctgaaagtccagttgtctctacgtcaaatacgacatacgttgcatcctctaacaaacggtgctctggattataggcaataggtactccgtcatcgaccaagttgatttccacaccatacatcattttgatgtcatgctttttacttgctgcatacgcatctgggaaggattgtaccaccgcatgatccgtcagggcaatcgcttcatgtccccatttttttgcttgttccaccagcctgccgatgccagtaacagcgtccatttggctcattggggaatgcaaatgaagctcgacgcgcttttcaccctcaggagccgtatcttccttcagctgaggtttcatttcattgacgtcattggcaatcatgacaaggtctctaacaaacgtatcgttttgaatgcttcctcttgctttgacccacatgccttttttcaatgatttcatcagctgtgcatcttctttttctcttgcaaacattttgattaaaatactgtttgtataatctgtaattttaaagatacaaagcgttctgccgcttttcagctcacgcgtttctgcatcgaatacgtagccctggacggtgattcttctttcctcgtccataatactatcaagcgtacgaatttcttcattgtctttaatttgatagccaatcatgagagggccagacggaccttcctcctgctcctcactttccttcttctccatctcagtgagggcttgcatcgctctttcttgatcttcagcaagcttttgttctctgaacttctgaatctcttgatctgatacaaaaatttctgtatcaaattggagttctggaaagcctacttgtttaaaagcagcctggagcattggactgtacttcttcttgatggccaaagcctctgtttcgctttttgttttaatgatgattttatgtccagacagcgatggtttttgctgctgaagcaagctgataattggaggagaaattccttgaagctcttccacacaatgtgaccaatacgattgaacgagctcttcagagatgctcggatcattgacttcaatcgtacaagtgacttgtgcaatatgagaaaatgcattcgtcagcctgctgagaaacatcgcatacaccttgtaaggcagaagcgccttaaatttaaaaaggaaatgccacgttttcgtcgccttatgcaccgtcaatttgacgatttctccttcttcaaagtaacgactgaggtcatcatctgtcatttgaatctgattgagtaatatatgaaattgccgccgtgtgatcggtaattgttcatccaagacaggaccctccttttgtcaatcagaaaggtacctcttttctacaggaggtaccttcatttttttgttcgttttttatgcttggcgtataaatgaaatcagctcatcaacagatacttcatgtgattcacctgattttctaaacttcacttcaacaatgccttcttctgaacgttttccgcagctaatgcgaattggcagcccaattaaatcactgtctgcaaatttcactccagcccgctcctggcggtcatcgaaaagtacgtcaaagccctcatcttctaagcgctcgtataacgtttcagctagctctttttgagcatcgtttttcatatttaatgcaaggaggtgaaggtcatatggcgcaacagcttctggccaaatgattcctttctcatcgtgatgctgttcaacaactgctgaaagagttctagaaataccgataccatagcatcccataatcattggctgtgctcgaccattctcatcaaggtacgtcgcatccattgactcagaataacgagtgcctagtttaaagacttgtcctacttcaatccccttagcaaactggattgtgccttctccatctggagaaacgtctccttcttgaatcaaacgaagatctgtgaattctttcactgacacatcacgcgcaggattgacattgacatagtgataatccgcttcgtttgcacctgcgacagcatttgtcatgcctttaaccgcaaggtcggcataaatatcgacttctgcttccagcttcactggaccaacaaatccaggctctgttccaatgacttctagtacttcttcgcgagtagcaagctctacaagctgtgctcctaccaagtttttcactttcacatcatttacttcatggtcgcctctcgtcaggatgagaacatacgcatcatctgctttaaacaaaacagacttgatacaaagagaaggatcaacttctaaaaattcagcgatgtcttgaatcgtttttgcttgtggtgtatggactttttcaagttctttgaagtccgcaggatttgcttcttctccttgatatacagcttcagccatttcgatgttcgcagcataggaagatgtgtcagagtatgcgattgtatcttctcctacttctgacagtgccataaactcatgtgtatcttttcctcccattgcaccagaatctgcaataactggtctaaaattaagacctacttttgagaatacattggagtaagctgtaaacatcttgttgtatgtgtcatcaaggctttctggtgaagaatggaatgagtacgcatccttcataataaattcacgtccgcgcagcagcccaaaacgcggtctctgttcgtcgcggaattttgattgaatttgataaagagttaaaggaagcttcttatacgattttacttcgctgcgtacgagtgatgtaatcacttcttcgtgcgttgggccaagtgcgaactcacggccatgacgatctttcatacgcatcaattctggaccgtatgtataccatcttcctgactcttgccacatttctgcctgctgcagcactggcattaacagctcagctgctcccgccttttccatctctttgcgaacgatggattgaatatgttggatgactttatgagcaagcgggagataatgatagattccgcttgtattttgtctaatgaacccagctcttactaagagctggtgactttttgcctcagcatctgccggcacctctcgaagagttggtatgaaagtcagggattgtctcatgtcgttacacctcatttatgaaataggacttctcacaaaaactcttgtttcccgtaatgagaaacaagagacattggttttataaaaataatcgctggatgtcattccacgtaaccactagcattaacagcatgaggaatgcaacaccgataaagacaacaagtgcttctttctcacgattaattggtttaccgcgaatggcttcaacaaacaagaatagtaaacgtcctccgtctagtgcaggaatcggcaataaattcacgatacctaagttaatactaaggaacgccgcaaactgcattaatgttaacacaccttgcttggctacttctcctgtcatgtcatagattccaacaggacctgctaacatatctaatgaaaattgtcctgtgacaatcttttgcaagttcgttaaaatcaaacctgctgttgaaatcacagttgttcctgaggatgaaataaccttcagaaatccattttccgttggcggataagagccaaaacggccaatgttttttccgtctgctttcacagcttctggtacaacctgtacagtgctttctttgccatctcggtcaatgacgacattcatttttttctcagggttcttttgaacggtttgaacaacgtctgtccaagaattcattttatccccgttaatggacacgatgtggtctccctgcatgagtccagcttctgctgcgcggccgtctttcgtcagcttgccgagtacagggtcatcaacggtgaccccttgaataaaccctaaagcaactaaaatcacatacgccaagataaagttcataatcggtccagctgcgatcgctttaatacgctgccataccgtttttgatccaaattggcgattgtacggtgcgatttgaatctcttcaccatctgcaatataaaagcttgtttgactcacattgtagccagtcaaattatcttcatttccagcttcatatcctgagattctcatggcatgatctaaatcaatctgctccacttcgatgacaagagcatcaggatatttttctttatcatttaaaatgattttttctacttcattttgctcattgaataagagccccactgtatgacctggtttaatttcaatgacttcagggtcctctcctgccattttaacaaatccgccaatagggagaagtctaatggtataaacggtttcctttcgtttaaaagagaaaatcttcggtccaaaaccaattgcgaactcacggcataaaatccccgctcgctgcgccataattaaatggccaagctcgtggaaaaaaacgagcgttccaaaaataataataaacgcaatcactgtattcacgaacataccaccttatgtgaggattgattgaacaaagtctcgtgtatctttgtccacttcatggatatcttgcaaactaggcgttgaaatcacatgatgtctgtttagtgccttttcaatcaattcttcaatttgcaggaacgttactttgcctttcagaaatgcatcgactgccatttcatttgctgcattgagcacagcaggcattgtccctcctattttacctgattcataagcaaaatgtaagcagcgatacctgtcaaaatccgctttttggaaattcaattgtccaatctcccaaaggttcaatgatttcgcttctggtaatggcgctctgtcagggtatgtgagtgcatattgaatgggcactctcatgtcaggtgtccctaactgagccatgacgcttttgtcgtgaaattccaccatcgaatggataatgctctctttatgtaacatcacatcaatttgttcataaggtatatcaaacaaccaatgtgcctcaatcacctcgagccctttattcatcatcgtcgctgaatcaatggtgattttcgcccccattgaccaatttgggtggttcagcgcttcttcaaccgtaacaccttcaagttcagttcgttttttatctcggaaactaccacctgaagctgtcacgattaagcgttcaatgtttttagcttgttcaccttgcaggcattgaaaaatagcggaatgctcactatcgacaggaagtaaaggtacatcatatcttttcgcgtactctttaactatatgaccagctgtcacaagtgtttccttatttgcgagtgcaatcgtctttttttgttcaatggcctttaatgttggaacaagcccgacacttccgacaagggcattgaccacaacgtccactgcatcataggtcgctgcttcgatgttggcttcatcacctgcagccattttgacatcgtattcaaatgaatgaccttttagcgtgtgataagcctcttcacttaagcatccgacaaattcaggctgaaactgttcaatgattggtatggccttgtctacatttcggccaaacgtcatggcttttagcttaaatttgtctgggtgctgcctaatcacatctaatgtttgttctccaattgatcctgttgcgcctaatagcgaaatatatctcaaattgccactccttctctcgttcaataagtttctatgaggttagctggcaaacgttgcgagcaataaatataaaaacggcagaacgaataaaaagctgtcaaacctgtccaaaatcccgccatgtccagggagaattgtccctgaatccttcacgtcgtaatgacgctttaaagcagattccacaaggtcgccaagctgcccaaagatactgagcaaaagcgtaataaacataacaagcagatatgatggcaaaaatcctgtaaccgcctgaaacacaaatgacaacacgaccgctgtgacgattccgccgataaatccttctactgttttgtttgggctgatctctggccagagctttcgtttccccatcgatttcccaataaaataggcacctgagtcagtggaccaaataatcactgctgcgaagaagatcgcactcatgccatataagcctctaatttggataaaataatagaaactaacgccaatatataatgtcgctaagatcacaaaagcaacctcatcgaatgtgaaagagtttttgctcaacactgtataagttaaaagaattaagactgcaaataaagcaatctgcatttttgatgcgtctgcgttcgggaagaagctgttctctccgcccattaaaagccaaagcaatattaagctgacaataccaggaaagctaaaaatcgatatctttttcattcttagaagctcaaagagagcgacacttcccattaagtaaatcagcagggtaaatggcatctgtccatatataactgcaagtaaaaagactgcagctgccaacacacccgtcaaaattctttgtttcatctgcaccaccctctaaattccaccgaacctccggccgcggcgctggtattctccgatagcgcctataagatgctcatcagaaaagtcaggccaaagcacatccgtaaagacaaactcgctgtacgcaatttgccaaagcataaaattgcttaatctaatttctccacttgtgcgaataagcaaatccggatcttgaagagattctgtcattaaataagctgaaaacatctcttctgtgatgtcttctgcttgaagcttaccttctttgactttttcagaaatttgtctgcacgcggagacgatttctgtgcgccctccatagttgagcgcaaaattcaaaacgagtccgtcattattcgccgtactctttactgcgttctctaccgctcttttcgtatgctgcgggaggccgtctggatcacctgttaagcgcacacggacattttcctcgatgagctcgggtaggtagatgttcaaaaattcctcaggaagtttcattaaaaagtctacttctaattttggacgtttccaattttccgtagagaaagcatacaaagtcagcactttgacattcagctcatttgcaagctttgtcatgcgcttgacgactttcattccttcatgatgtcctgctacccgtggaagagcacgtttttttgcccatcttccgttcccatccatgataatggcgatatgttcaggaatttctccatttaatatgtcttcttttgtcagactttctaagttggaagctgcagtttgctgattcttccaatttttgagtatattgagcatgagattcctccatcacccaaaaaggttgcgtttccgctaataatatagtcaccaacagtattaacaaaaaaaccccctgtaaacatgaagagggtcttttcactattatctattgtacatagttttttcttaaacttccatgatttctttttctttatctttcgtcacgtcatcaattttagcgacatattcatctgtcaatttttgaacatcctctgttgatgatcttaattcatcttcagtgatctcaccatttttctctagctttttcaactcatcgtttgcatcacgacgaacattacgaacagctacttttgcttcttctgaatattttcttaccactttcacaagctctttacgtctttcttctgttagtgcaggaatcgcaatacggatcacatttccgtcacttgttggcgtgatgccaagatcagacttttggatcgatttttcgatatcaccaatagctgttttatcataaggtgtgataatcagcatacgtgcttctggcactgtgattgacgcaatttggttaagtggtgtttgtgcaccgtaataatcaaccgttactttatcaagcaatgaagcatttgctctgcccgcacgaacagttgcaagttcacgtccgtatgcttgaacggctttttccattttttctttcgtttggttcaatacttcttttgacacgttatttccccctcacaatcgttccaattgattcgccatttacggcacgtttaatatttccttcttccataatagagaatacgattaatggaatgtcattgtccatacataatgaggacgcagtagaatccattactgcaagcccttcttttagcacatcaagatatgaaagcttgtcatattttactgcatccgcatctgtacgaggatcagcactgtagacaccgtctacattatttttcgccattaaaatgacatctgcttcaatttctgctgcacgaagtgctgccgttgtatctgtagagaaataagggttaccagtacctgcagcaaaaatcacgacacgtttcttctcaagatgacggatcgcttttcttcttatgtatggttctgcaacctgtctcatttcgatagaagtttgtaccctagactgaatgccaagcgtttctaggctgtcctgtagcgcgagtgaattcatcactgttgccagcatgcccatatagtctgctgttgcacggtccattcctaagtcactacctgtcttaccgcgccaaaggtttcctccgcctacaacaactgcaacctctacatctagctctgcaatttcttttacttgctttgcgattgaatgaatgacagttgggttaattccatttccagcatcacctgctagtgcttcgccacttagcttcagtacaatgcgattatatttcggtttgctcatgataacctccaagtgtaaactataccgtctcttattatgcgtaagaaactgccttttgtaaatcaatatcctctaaaaaatagggaacacagtgcttgtgctccctaaaaaagccccagagagcttttcaaacattattttttcacttggctcattacttcttcagcaaagttgtcttgacgcttctcgatgccttcgcccacttcatagcgaacataagtttgaatgcttgcgtttttcgcagctactacttgtttcactttttcatctgggtttttaacgaaagcttggtcaagtaagcaaatttcttcgaagaatttgtttagacggccttctaccattttagctacgatgttttcaggctttccttcttgaagcgcttgctgtgttaatacttcgcgctcacggtttgcttcttcttctgacacttggtcacgagaaatgtatttagggtttacagcagcaacgtgcattgcgatgtctcttgcaagctcttcgtcagttgttccgttaagaacagctaacacaccgatgcgtccgcccatgtgtaagtaagaaccgaatgctgcgttatcttctttcgtgataacagagaaacgacgtagagtgattttctctccgattttcgcaattgcagatgtgatatgctcttcaactgttgaaccgttttccattttagaagcatgagcttcttcaattgttgcaggtttagcagcaagcaaatgatcagcaagttcgttaagaagtgattggaacccttcgtttttcgaaacgaaatcagtctcagagttcacttctaggatcacgcctgtgttgccgtcagttttgataagagttaatccttctgcagcaatacggtctgcttttttcgcagcttttgcaattcctttttctcttagaagatcgattgctttgtcgatgtcaccatcagtttctgttaacgcttttttacagtccatcatacctgcaccagttttttgacgcagttctttaactaattgagcagtaatagccattttacatttcctccttctatgttaaaacacggattactaggtgaaaaaaaggtgataaaaggcatttccctcttatcaccttttgaataggttacgcagttgttgtttcagtttctgtcgtttcttctacaacagcttcttcttcgccttgtttagactcaagaatcgcatctgccattttagcagttagaagttttacagcacggattgcatcatcgtttgcagggatcacaacatcaatttcgtctggatcacagtttgtgtcaacgataccgatgattgggatattcaatttacgagcttctgcaactgcaatacgctctttacgagggtcgataatgaaaagtgcatccggaagacctttcatgtctttgattccgcctaggaatttttcaagacgttctaattcttttttcagttgaacgacttctttcttaggaagaacatcgaatgtaccgttttcttgcattttttcaatatcttttaaacgtttgatacgtttttggattgtttcaaagtttgttaaagttccaccaagccagcgttggttcacatagaacataccagaacggattgcttcttctttcactgaatcttgtgcttgctttttcgtaccaacgaaaaggatttttcctccgtcagcagcaaggtttttcgtgaagttgtaagcttcctctacttttttcaccgttttttgaagatcgatgatgtagataccgttacgctctgtaaagatgtaacgcttcatttttgggttccaacggcgtgtttggtgaccgaagtgtacaccagcttctagcaattgtttcatagaaataactgacatgttgttgcctcctaatataatggttttttttcctccgcttaagtcatgttcacataaaactgcgccacggcagcaccttcatacgaatcattaagcgtgtgtatttaacaccaagaaataatataacacatgatggactgacaatcaagaatcctttacagctttccgctaaattttaataaaagctcgatttctgtcttgccagttttcagttctttcgctatttcttctagcgaatgccctttgtcatataaggtcttcacttgatcctcgaatgtttcttctatttcactttcagaaggcacagaagcttctgattcaaaatgtggaacgggttcgtttaccttctcttcctgcacttctacctcgctaaggagagccgacaagtgctctgggactggatcttcactttctaccgattgctgggattcaattggtgtttgtggctgctttggtgtctgaaaatccgatttcagctcttcagcagaaaaatcaggggaagcggctgccacttttgatagtttgtcattctcttctttgacttccatcaaaaatgcagccagggtattttccgtttcttctagaagttctcgctgcttttgttcagttgccttcagcgaattcattctcgtatataaaatgatcacaaaataaataagtgcagcatgaagcatgaagctaatcagccataacatattttttcactcactaactctttaagattgaatggctttatcaagcagatgcttcagcttgaacaatgcctttgaatgaatttgcgaaatgcgtgaggtcgataaattaagcacgtgaccgatttccgttaacgtcagttcctctttatagaatagactgatcacgagcttttctttttccgaaagctcggtcattttttcagcgagctgttctattaattcatctttcagcatcttttcttcaggtgtcacagttttctcgtcgcgaatcatgacttggacgttttcaccgtcttcttgatcatgcagcttctcgtcgattgaaagcagatttgcaaagaaaccttcattcattgttgtgacaacatcctgttcactcatgccaagttcctctgccacttctgtcggcgtcacatttcgtaaataacgttgttcaagcttttcaatagccgcttctactttttttgttttttctcttgatgtacgaggcagccagtcctctttacgaagaccgtcgatgatggccccgcggattctgaaggatgcatatgtatcaaacttcagatctcttccggggtcgaatttttcaagggcatcatataaaccgagcatccctagactgatcaagtcttctttatgcactgacttcgggagaccgatggaaattcttccaacatgatatgtgacgagcggcatatagcggcgcataagatcatctccagcagctgggtctttccactctttccatctagcccatagcgcctgatcttcgtaatttaaggattgcatctttctccccctatacttccttagttatatcttcataatgccttgcttcacagtgcggatctcaagctctgtcgtaagcggatcaaattcaatcgtacggccattgttcccgcccgtatcctctctaatgatcgggatgcgataaagagacagatgttctttaacagctgatacgtttctaggtccaattctcattagatcattggttgacttaaacttaaacatttctgcgccaccagcaagttttgcctttagcgcatgtttgcgcgctccttctttaaggagcagatcaattgtatgcttgacacctgtatctgcatatttagccaagttctccactgccccttttgcaagggatgagtctggaagcatgacatggacaagacctgccagttttttttcttgatcaaacagaacaagccctacacaagaaccaagtccggatgtccgaatgcggtccggtgttttcacaagctgaacatccgctataccaacctttacaactgccggaatctgaacgttcattacaggttacctaatgctttgaatagtttttcaaacgattcaaagtctggtaatagaaacatatttcctttcagctcttgcttattttgatcatcaaaaatcgatgtatcaatcacaattgcctgatcacctagagggctgaattgtattaacccttcgctaatgacagccccgaacatatcgagcgtaacatctggaacacttgggtgaagctgcaattttgttaaatcggcaagggctgataaataagagcctgctaaaatatttcccagctcatgtagtgctgacgtccccatcacatgctcgtgaatagtatcaatatcaaatgacggatctcgtacaagctctcttacgaattgctcggcttgctcaaagggcataatgaaaaagattgagccggataaatctccttccattcgcaggaaaatgcttgcaactgggaggtctgcaccgccaaagaaatccattaattcttcaaacgagagaaccttgacaaacggaacagccatatctattttgcgatccaataggctggcaagagcagacgcggcgtggcctgctccaatattcccaacctctcttaatacatccagctgttcatcttttatttcattgaaaatgctcatttcacatcctccttaatgaacaggtgcatcttgaacgctcttgtcgaggacagcaccaggatgaatgatattaaatagacgctgatcatgcttaatgatacctgtcacccatgattgtccttctttttcagctgattcaggagaagattctacttcttcttgatgaactgtaatgacgtcatttgcttcatcaacaatccagccgacttcaatgtcaccaacttgtacaataatcattcttgtttcatctgtaatttcgttgtcacttgatccaagtctcactctaagatcgatgacaggtgtcacgacaccgcgcagattaataacaccgcatatataaggggcaacgccagggactcttgtcggctgctgccatttttcaatggactttacttctgatactgaaatggcgtattcttttttgtttacgataaacacaatcatcttttcgccagttttgatatctgtactcatttcagaccgctcctctattgttttttacttgatcagtgcattacagtcaacgatgagtgcaacttgaccgtcgcctaggattgttgcgcctgaaatcgcaaacacgtttggcaggtaatctcctagtgatttcaatacaacctcttgctgaccaataaatgaatcgaccacaaatgctgtcagcttatctcctttacgaacaacgatgatgtgcagttcttcctctaattcattcgcatttggtacgtggaattgtttcttcaagtacacgaccggtacgataaatcctcggaaatcaatcacttcacgatcatgcgtttgaaggatgtcgcttttcttaatgacagccgtttcaataatagaagaaatcggaatcgcaaatgtttcctcttccagtttcacaagaagtacagaaataatcgataatgtaagcggaagctgaatcgagaatagtgagccctgtccttctgttgagttgatactcacagatccgcccagtgattccagcttgtttttcacaacgtcaaggcctacaccgcggccagagatgtcagaaatcgtatcagctgtagagaatcctgctgcaaagatcaatgaatcaatttgatgatcttcaagtgtctctgcttctctttctgtaataacgccgcgctctaatgctttttcaagcactttcttacggttaattccgccgccatcatcttctacttcaatgaagacgtggtttccgctatgatacgcctttaatagaacggtgcctttttctggcttgccttttttcacacgttcttctggcgattcaattccgtgatctagactgtttctaagtaagtgtaagagcggatctccaatctcgtcgataactgttcggtcaagctctgtctcagcaccttcaatgatcagttcaattttcttattcagctcttttgtcaattgacggatcatacgagggaatcggttaaacaccgtttcaacaggaaccattctcatgttcaggatgatcgattgcagatctccagaaatacgtgtcattctttcaactgtgtctgtgagttcattattttctaattctttggcaatctgttctaaacggcctctgtcaatcaccagttcttcaaatagattcatgagagaatcgagacggtcaatgttgacacgaatcgtttttgttccgccggcagctgcaccgttattgccatttgcttttggcgcatcgtttgctggtgctttcgcagcaggcacagagacttcttctttttcctgttcaggttttgcctcttgtttttcagctggagccgcttcttcaaatgcagaaacttctgagatctcaacttgttcaacttctgagatcgtcatcacgattttcttcacttcgtccattggttgtttagataaataagaaatactgaattcagattcgaaatcttctgattctaaaagttctgcatttggaactgttttaacgacttcgcctgcttcgttcagtctttcaaagatcatataaacacgaacggcttttaataagcatgcgtcgcttaatgttacattgagttcataacatttaaagccttgttctctcgcttcatcaagcactgttcgttcaaattcgttatagtctaaatcgttagcagccgctgatacatcagctgtttcaacactaggagctgcctcagcatggcttcctgtcacatctaactttttactaatctctgtgacatcgcgtttcccatcgccgccttctgcaattgattgaaccattgcttcaagatgatcaagcgcttcaaacattgtgtccattgactcaggtgtgacaatcatttgttcatttcgaatggcatcaaacatgttttctaagtgatgtgttagctgagccatatcagcgtagcccatcgttgcactcatgcctttcaatgtgtgagccgctctgaatatatcattcactagctgcaagtcggttgggttcttttctaaatcaagaagtttttcattacaagtttgtaagtgttctctgctttcatctaaaaagatatctaagtattggtttacatccaacgtgttcacgccctctctttattcatggagcttataattgcatgtgcgatgtcatccacatgccttgtttcatgtgcaaggcctgctttaatgactgatttaggcattccgaaaacaacacatgattcttctttttctgcaatgacttttgtatgaccgcttgcgaccatttttttgacaccttctgtgccgtcactacccatgcctgtcataatgacagcgattttctcgtaaccctttatatgactgatggattcaaataaatagttaacagaaggtttgtgccggctttctgtgtcctctggagacagcctgatgactaaggatgccccttgttcatgaagtgacatattcattccaccaggtgctatgtaagccactccatttttagcgatgtctccatcttgtgcttctttaatcgaaatttgagataaatggtctaacctagtagcaagtgatgccgtaaatcctgccggcatatgctgcacaatcaaaatgggtgcttctatgtccttgggcagcttcgtgacgactcgttgaagtgctcttggcccacccgttgatgttccgattgaaataatctttcgaagtgagccgctttttactgcttgcgggcgaggtgcagccaccggaatcggcggcttcatcacaggcttaggagaaacctgcatttcagtacgtttccttgacagccctgccgcaagcacccgttctacaatttggcctcttactttgtgtaaatcgagcgaaatacttcctgaaggctttgtcacaaagtcaaaagcaccaagttctaagcaatggatggttaaatccttcccttgctttgtctggcttgacaccataatcacggcaaggtcgtgttcagccagaatttgttttaatgcttctgttccatttaaaacaggcatttccacatctaatgtgacgacatctggattcagttccttgatccgttttaaggcatcttccccatttcgcgccgttccgacgacttctatttcttgctcggcacttaggaaatcactaatgagctttcgcataaaggccgagtcatctactacaagcactctaatcacgagtccaccttcctccttttaaaaaaagaggacaacttatctataaacgtatgctgctctctctgtgcctctcttatctgctgttgataaagtgtttctgccagcatcttgatcgttttacttagccttgaatgaggctgcttcatataaaatggaatttgttcggccactgcttttggaaccgcaggatcatccggcacagcgccagcaaataccagttttctgtgtagaaatgatgtgaccactcctgctaattttctgtaggtttcagacccttctgacggggttttacaccggttgacaatgatttgcacagattgttcgaactgatgaatcgctaagtgtttaattgcgctgtaagcatccatgatcgatgttggttctggcgttgtcacaaccactacttcccctgctgataaaacaaaaggcagttgatcttttgaaaggccagcccccatatcaaagaagatacaatcaaagtcgtgcatcattctttccatttcctcaagaaagaacgaccattgatctttatctaaagaaaacagctgttcaagtccgcttccgccagaaatgtaatataggttgttcgttccttgagtcatagccgcttggaaggatttcttcctgacaagaacatctaatatagagctggtcgatgttttccctagtaaaatatcaatattccccataccaaaatcaaggtcgatgactaacactcgcttacctgcatttgcgatagacagtgccatattcagcgtcaaattcgattttccaaccccgcctttaccactcatgacagcaatggtttttgcctgtccgcttataccaagaggagctggtgtgatcgtttgattctgctgaacgagctttcttaaaccttctgcttggtcgggcttcatcattgtaagaccatccttgttaattcaagaggagagccctcaagaatatcctcaggaacattttgaccatttgttaaaaagccaagtccaatttgagagtttgcaatgatttgaaagatggttcccatcgtgtctgtttcatctacctttgtaaaaatgaattgatcgattggaacgtgttcaaagcgtttaaccatggctttcatgtcctgatacttcgaggtcgcactcatcactaggaaactttgaatgctttcattaaatggaatgatgtctgtcagctctttgatatacgcttcttctttaaagttacgacccgctgtgtctacgaaaatatgatcatactctttaaaggtctcttgagctttcacaaaatcctctctagaataacaaacctcaagcggtgcattgagcagttccgcatatgttttcagttgttcgatcgctgcaattcggtacgtatctgttgtaataaaagcgattttcttttgcttctgaatggccgttttggcagcgagctttgcaatcgttgttgttttaccagcgccagttgaaccaaacagcacaatgtattttgaacgaatcatcggctcatcagaggtgtgagccggcagcatatctgtcagcagttgttcaagttctttatgaatttgatcttccttgacagcacccttcgttaaaagaccttttaggcattcgtctcgaatggcatcatcaagaccttgatccttcagcttttgatcgattgccatgagagggtctggcagaataccagcatgccgctcatttctctcatattctaaaggccgagcttgagaaggtactggtttcactgcctcaggcgcaaaaggcggctcttcagaccggtgtggaacgtgctcctttttcggaattactggaagaggaggcgcaggatgtccacctttacccgctctttcttcaaaatcttgatccagtactgcaatcacttcaaccatttgctgtttttttaaaccgaatagctttcgtttcacaacggttttggaatttaaaatgacggcatccttcccaagctgctgcctaatttgaatcgttgcctcctgcattgaattcgctatgatttttttcattttcattagatatccaccactccgatgctctgtacttccacatttgcttctagttcgttataagataataccggtaagtccgggaaatatctttctaacagctgcttgacgtacattctaataggaggtgagcacaatagaaccggcgtttcctgacgaagcgaaagctgttcaatttctctcgccactgattgaatcacactttcagaggattctggatctaacgataagtagttgccatgctctgtctgctgtacactgtcagcaatcaccttttcaactcgacctgagcatgtcacaactttgagcgattcattttctctcgcatattgtgcagtaatctgtcttgccagtgcctgtctgacatactctgttaacaaatctgtatccgtcgttaattttccgtagtctgcaagcgtctcaaaaatggtgacaagatttcgaatagaaactttttctttcagcagttttgcaagcactttttgaatatcaccaactgctagtggattcggggtcacttcatccactaagacaggataactttctttcagatgatcgattaattgcttcgtttcttgacgtccgagcagttcgtgtgtgttttgtctaatcttctctgtgatgtgagtagacacaacagatgcaggatctacaaccgtatagccgagcatctcagcctgatctttttctgcttctgagatccatttagccggaagaccaaaggatggctcgattgtttcgattccttcaatcggatcatcatcaggcgtaggcgacatcgctaagtagtgatcaagcaggagctcgccttttgccacttcgttccctttaattttgagtcggtactcatttgggttaagtgcaatgttgtcccggatccggacaactggaatcacaagaccgagttcaagggcaagctgccttcggatcatcacaattcggtctaacaggtcaccgccttgatttgcatcggctagcggaatcagaccgtagccaaactcaaattcaatggcgtccatttggagaaggtgaatgacgctttctggacttttcatctcttctacctctgcctgctcctctagtacctcttctatttcttcttgatcctgtttgttttttgacatcaagtatgcgccgagggcaagtaaacctgcgatcggtcctgtcaaaagtacgccgattggagtaaacaacccaagaaggaagatcgtacctgctgtgacataaagcatagctgggaatgcaaacagctgttcagtgatatctgaaccaaggttcccattagaagcagcccttgtgacgacaatccctgttgctgttgaaatgagaagtgcaggaatttgtgaaacaatcccatctcctaccgttaataatgtaaagtgggaagctgactcttgaatcgacattccttgctgaagcattccaatgataatcccaaaaataatattaataatgacgatgataatacctgcgatggcatcccctttgacgaacttacttgccccatccatcgcaccataaaagtctgcttctctcgctactttttcacggcgatttctcgcttcactttctgtcagcatccctgcatttaaatctgcatcaatactcatttgtttccctggcatcgcatcaagggtaaatcttgccgcaacctctgaaacacgctcagcccctttggtgattacaacaaattgaatgatgatcagaataaggaagaccaccagacccacgagtatatttcctccaacaacaaatgaaccaaacgtttctacaacctttccagcgtctccagttgataggatagaacgtgttgtagagatgttaagccctaaccgaaacagcgttaagagcaaaagcaatgatggaaatattgaaaattgcagtggttcttgcatgttcattgtggtgagaagcacgataagcgcaagagaaatattaataatgattaaaatacttaatagcattggcggaaacggtatgaccagcatcgccacaattaaaataacactgaataaaacagataaatctcttgctgacatgcctgttctctccttttaaaaccaaaaattcataaaatcttttgtttcgttttataaacatatgctaaaatttctgcgatcgccttaaagtattcctctggcaccgcttggtcgatgtcgacctgatcatagagtgcacgagcgagcggccggttttctacggtcataatatcgtgctctttcgcaatcgttctaattttcaaagccaaaatatctgttccctttgccacaacaaagggcgcgtccattttttcttcgtcatatttcaaagcaattgcatagtgagttgggtttgtaatgatgacgtccgcttttgggacttcctgcatcatccgtctcatggccatttcccgctgacgctgtttaatctttgattttatgagcgggtcaccctcagattttttatactcatctttgatgtcttgtttggacatccgtaagtttttttcataatcaaatttctgatacatataatcaagccctgctaagatcatgagagcacctgctgcatataaccccataatcaaggtcatatttgcaacgaaatgaagggtttcctctgctgttaataaaggaagcctcaggatttcgtcaaagtgcatccaaagtgcaataaatgtggcaaaaccaattaaaccaattttcaaaatggattttaatagctcaacgagggctcgaatactgtatattcgtttaaaccctttgattggatcgagtttttctaatttcggtttgattacttctgtcgaaaagagaaagccaacttgcaaatagttactgatgatccctgccagcataccaacaccaaggattggcatgaggaggagtcctgtttcctgaagcaattccacaaatagttgatgaatattagatgtgctaaccttcattagcatggttgttgaataaaaacgttcaatgagcgcaataatacgctctttcataaaaggcccaataaaaaagaatgataaaaagattaatagaaatgagatggctgtattgacgtcggtacttttggcaacctggccttttttacgtgaatcttgtctctttttcggcgttgctttttctgttttttcacctgcgaaaaattgcaagtctagtctaagccttgtcatcatgacgaaccaccgaccaatgctaagaaattcctcatggtgagtacaatcgtatcaaatgtattttggacaactccgaagatgacgcccatacagatgatgatcataataaaactcacacccattttaataggaagtccgacaacaaaaacgttcatctgcggaactgttcgtgccacaatgcccagtgccaagtcgaccaaaaacaagctggcgacaaccggtgctgagatttgaaaggcaatgatgaacatttggttgaagctctttgcaataaaataagcaaaggattcactgccgaaattcagtgcgtactgatcaactgcaatatactgaaagctgtaatagattccatcaagcagcaggtggtgtgcattggttgccagcatcaatagcaatgtgaccgtataaaaaaactgccccatcagcggcgtttgtgcccctgtttgcggatcaattacattggcgatcgcaaagcccatttgaaaatcaataaatgagccggcaatttgaacagcggacaccatgatatatgcaatcaaaccaagtagaagcccgaccattgcttctttcaccgcaagcatcatataaagaccgtctatgtcgagtgctggcggttccttaatcgtgctaaaactaattacagctaaaaacagtgagaatccaactctgtgtacagccgggatcgttctatgcgctaaaagcggtactgtcacaaaaaaagcggtgattcgaataaaaactaatagaaaagcagggaataattctatgattgacatcgctcgttaacctgcaaatcgatctaaattcgagaacagctctgtcgtaaaggacacaatggttgacagcatccatggaccaaacacaacaagcccaataagaactgcaacaattttaggaatgaacgcaagcgtctgttcttgaatttgggttgttgcctgaaacacactgacaatcagtcccacaataagagcgagcgctagaagcggcccactgacaagcaataccacatacactgatctttcagccatcgtaatgacaaattctgaactcatgttttaagcacctactctaaaagctttgcagcaaagatttaacaatcaaataccatccatcgactaaaacaaataacaatattttaaaagggagcgatatcataaccggcggaagcatcatcatccccattgacatcaggacacttgcgacgaccatatcaataattaaaaatggaataaagatcatgaaaccaatttgaaatgccgtctttaattctgaaatcgcaaaagcaggtaccatcgccgttaacggaatatcttttatcgattcaggtgtatccatttttgcgtaactaagaaataaagccaaatccttctgtctcgtatgtttactcataaactctttaatgggcacttcggctttttcatatgcctgattgagcgtaatgtcatcatttaaaagcggcgtgagtgcctctttattaatctctgagaacgtaggtgccatgataaagaatgtaagaaacaaagcaagccctacaagcacttggtttggcggcattgagttggttgcaagggacgttctaacgaatgaaagtacaatcacaattcgtgtgaaacacgtcattaaaatgagaatgcctggtgcaaccgaaaatacggttaaaagtaaaagaagacggacagacgtgctaatattccctgcaccgctggaattaaataaatcgataaactcattcattttgtttcgggcctttctttctgacttctgattgggtctttttcaattcggctagctgcgccttcaaattggctgaaaaagaagaagtggttggctgatcctgtttctttatctgagatgtgaatttttgaacgatttttggtaaatctgttttgctttccatcgcttcttcgtattgttgcacgatcgcttcacattcttgttcatcatcaatttcttttagtagctggattgagtccgctactccgacaactaatactcgttttcccactttgataagctggactgaacggttttggccaaccgtcgttccgccaatattttcaacatagcgaaatggtttaagtaagcggttttgcttaccaacaaatctcaccaatccatatataagcaggatgacaaaaagtaaggcaccaatcattttgacaaaatccataatggagacagaagaagagggaacttcttctgccggagtcgtttgattgtcagtggttgtcttttctgtatcctttttgctgctcttctcttctttgagccagtcattcactgtgccattttcaggatctttcgtttcagcaaacagtgaggcaggctgtatcgttaagaaaagcataaaactgatcattgctatacatatcaaacgttttttcaacaagtcttacacccttttttagcctaacgttttattaattgcttcaagtacacggtctgcctggaacggcttcacgataaagtcttttgcacctgcttggatcgcgtcaataaccattgactgctgccccattgcagaacacatgatgatttttgcagaagcgtcaatttgtttaatttcttttagtgctgtgatcccgtccatttctggcattgtaatatccattgtgacaagatctggagacgtttctttgtatttttcaactgcttgagcgccgttttctgcttctcctactacatcaaatccgtttttcacaagaatatcctttatcatcattctcatgaatgctgcatcatctacgattaataccttagtagccatttacttattctctccctgtatgtttgtttattttaaattagaaagtctttccgactgacttaaaatatcagtcacacgaacaccaaagttctcatcaatgacaacgacttcccctttggcgacgattcgtttgttaactagaatgtctactggctcaccagcaagtttgtccagttcaatgatacttcctgctgaaagctcaagaacttctttgacacttcgctgagttcttccaagttccaccgtaatggagagcgggatatccatcagcatatcaagatttccaagctggcttgttgtatgctgaggctcactgaatgcttcaaattcaactggtgccacatttacaggtgctgccggctttggcttcgcctgtcttttcggcggagctgcttgcggcgctggtgcagattgcgcttgcggcgctgcctgctgaggttcaggtgtagtcacttgagcttcttgaaccggctcttcctcttgcgcagggtctgttaattctgcaattaaatccttcgcaaatgtaataggataaagctgcataatatttgaatcaatgagttcacctatttttaatctgaaggacactttgacaagcatttcttcagctgggatccggtctgttccttctccttctttcacatcaagtaattcgacgcgaggcggagaaatatcaatctttttattaaagacagtcgacatggatgtcgcagcagaacccatcatttggttcattgcttcttgcaccgcacttaagtgaatctcgcttaaagaagggtcagcatttgtcccgtctccgcccatcattaagtccgcaatgactgctgcatctgtttgctggacgacaagcaggttactcgcgctgaagccttccgtataattcacttcaatcgcgacatacggatgaggaaactcctcattcagcatacttttttgaatcactgtcacagttggagtggtaatctccactttttgatttaatagggttgaaagtgctgtagcagaactgccgaatgaaatatttccaatttctccaatggcatcttgctccattgcagaaaggactgtatcaggctctatatcgtcattgctacctcctttaaggagcgcatcgatttcgtcttgtgataatttacttccgttattctccatcttcttcacctcttatgtcgtgatctagaatttgaatcgcctgtttccgattcacgcggccggcctgtcccaagaatttcggtttatttccgaccataacagtaagaggcgcatttactggtttgtccaaggcaatacaatcaccaatttccaaattcaaaaactcttccaccgtcatttccgattcccctagctctgcgactaccggtatctttgccgtcataatccgtttttcaatggcctttgtttcttgttgttttggttcatttcgttcagactgcatccagtagtgtacagacagcttcggaataataggctctaatacaacatgaggaatacataggttaataaccccgcttacctcgccaatttgtgtattaagagaaatgacgacaactgtttcgtttggtgacaccatttgaacaaactggggatttacctcgaaatctgccatttcaggctcgatgtcggttatagactgccacgcttctctgtaattttccaaagctccctcaaacatgtttgagataatctttgtttcgatttctgtaagtgattctgtcttattatgactaatgccaatcccgcccatcagcctgtccatcatggcatagccgattgttgggttcacttcaagcatgattcttccttcaagcgggctgacataaaataagtttaataatgtcatattaggaatcgaacgaataaattcttcgtatggtacttggtcaaccgagctgacagtaatttgaatatatgatcttagctgagctgaaaagtgcgtggtgagcagtctagcgaagttatcatgaatccttgttaaacttcgaatctggtcttttgaaaagcgaagtgcacgtttaaaatcatacacctttacttttttcgtcgtttcttcttttttcagctcttctgcatccatttcacctgttgatatggcggataataatgcatcgatctcattctgggaaagcacttctcctgacatttcttcacctccatcgtgtcaattaatcgcctctattgcagattaaaggaggttatatatacttctttcaccttgccatcttgcaaatagttattcactttgtttttgactagtgttttaaaatgttctctgccttttttgccatcaagttcatctgcatttgtgtctgataaaatgtcaattacggcgtctttcacttgaaaacttcttttctcaagctcttcttttgctttttcagagtctgtttcaatattcaatacaagtttgaccgcatttccttcagactttaaattggtgataatctcaggaatttcaacagaagcttttgcgacttcatctgctgttggctctttttcagcttttgcttcttctgaaccattcagcagaaaaatgatgcctgctcctattccgccgatggcaataatcatgattagcattactacgactaatttcttcttcattcaaattcctctattccttgattcaatgaaatgacttggatttttctgtagaaagaaatgattttctcttgaagttgctcttcattttctttcacaacgaatttctttccattggctaatgtaatggttgtgtctggaaagctttcgatttgctcgatatggagagcgttcagcataaatcctttgccattcaatcttgtcacttcaatcatattaagcagagaagcgttcatccgctccccctacctcctatcgtttcagattcacaagctcttgcagaatttcatcagatgttgtgatcgtctttgcattcgattggaatccacgctgcgcgataatcatttcagtaaactcgtctgttaaatcaacatttgacatttcaagtcggcctgtttggatgacgcccgttccttcttgaccaggtacgatagggttacttggtgcacctgaacttaacgtttggcggtaaaggttgtcaccaactttgtctaacccacctgcgttacggaaagataccagtgatacttgaccaacggttcttgatacattgttttcaacaaccgaaatcgtcccatctggacctacacttacacttgaaatgccttctggaatcgttatcttttgtccatccattccaagcaggtaatttccatcagaagtgactaaacttccctctgaatcaggtttgaaattcccagttcttgtataaagaatttctccttgactttgaatacggaaaaatccgtctccattgatataaaagtcgtaaggttcatctgtattttgagaagctcctgctgacatgattttatcaatagatgataaagaagatcctaaaccaacttgctttgagttgatcgaacccgagttgttcgtcggtccacctgagcttgaaattgtttgactgaccatatctttaaaagtgatacggctttttttgtaaccgtgtgtattgacgttggccacgttattggctacaacatctaattttgtttggaagtttttcattccgctaattcctgagtaaagtgagcgtaacatttattttcctcctcgaattacttcgttttttctccaactgctgtaacatcccaagggctgattttcgttccatcttctaaatacaggaagtattcattgtttatgtttttaacagatttcacagtgcctgatatatctttatcatccaatttgcccgatacttctttaccgatccaccctacatacgtcgtaaacggatcttggtgtgcaacaaatgtagacatgagctgattcagcttggtgatagaatcgttcatattggtttgctgttctaaagatgaaaatgtcgcaagctgtgtgacaaactcacggtcatctagtgggtttgttggatcttggttttgaagctgcgtgagcaatattttcaagaattgatctttcccgagcgtatctgttttcttttctgcttttgaagaagtgtctgtttgtgtttgtgcgactgttctattcgtagcatcaaccgttgccattagatttcctcctcttcttcatctgacccaacaagagcatccagtacatcttggaattctgcttcctgttcatcaggcttctggaaattctgcccttttgactgttgctgcttgttttcttcgttaaattgtccaaataacggctgttcatttgattgaagcggtatatggaaacgatccacttgaaccgacatattcggaagcgcctgcttgagctgcggcagatgatgctctagcagctcttttgctgcttgtgtcgaagcagtaatcttactcgcatacataccattttgcttcgtcagctgaatcgtgataaatccgagattttctggatttaatcgaactgtaaagcgtccgcttgagttgccaaatggtgtgaatttcatttgcttccacgtatttagaatttgctgatcaaccgttcccggcttttcatcagttgtttgtgtctgctgaacaggggctgctgattgcagttgaaaaaactgcttatgacctggcaaaagcgtatgagtgatcgttttttcagaagcagatgcagcagtgctttgccctttgaccacttcctttttgatgagccattcaagagaggcagcccctttagcaggagtagcaagagtagattcttgtcttggagagaccaattcttttaactctcctaaagcaatcttcaactctttgactgacccttttgcattcgccatcatatggtcgattaactgattaaagtgtttcagctcactttgagacatcgaattcagctttggagctgaaccctgcgagaaaaactgctcttttacttgctgaatcagtttctcatctaccccattttttgaaagaaagtgaatgaagtcttgaccctttgcttcaatatcttgcactaactttgcatcaaagctgagcggctgttgattgagcagttgatatatgaaaaagtggacttgtatgagctgctcactatgttcagaagctggcttatcagcttgatcaccgtaaatggatgattccattttttgaaatagctcttctagtgacttgagatcagacgaatcaagcgtttgaccttgaagtgtttgaagtgcgctaagaaggtctccgttgataccttcttcaggtgagtgcatccatttttcaatgatttgcatcgcatcattgatggaaagagtggcacccgttgtctcagcattcacaaggccgctttgtgcacctgccccgctaagtaattgtttaaacaacccgcttgcagaggccactccgctcccctttggtcccgcgagaccttgagatgattgctgtaaggctccaatatccaatagcttcacttattgtccacccccattttcactttcttttttagaaagctctttcgtaaacgtagctgccttctgaggtgttagttttgctaatatgtctgttagtttatttttgctcagctcttcgaggatcttcaatgcctctttatcacttaattctgataaaattttggcggatttccctgcgtccatgctttcatagatactggcaatcttccctttaggtttctggttagaggctgctgcctcatcagaagttgttcctgacgcattattacctgatgtatcgctcgatgagctgttgtttgatgaactgtcactcgctgacgtattattcgcatcattttcagttgttttttcaagtgaactgattttttgattcagtcttttaatctcttcatcacttgtttttaagtctttttgcgcaatttcaagttcatttttttgctctttaatggtctttttcagttccttcaattctgcatcgctttgattattatgtgaagatgacgtttttgaagtgtcatctgaaccaaccaaactgctaacgcccggaatgtgttggagcggtttctttagatcaaaacctgccatataaaggattgtgccagtcactaacacaagcacaatcaatgggatgatgacaataaacaagatccattgaaatttaccgccgcttgattccttcgttttttccttcttaggcattcatctcgactcctaatgtccttgaaacatgaattggctgatagagatatcatccatttctttcatttcaatggccttatgttcaagggaaaacttttcatactgcttttctttcattttttcaaactttttaaactcaatgtttttttcagttaaatcagattgtttttcattcatttgatggcgtttcatgatcacaagctgctgataatgctgaatcgtgttatctaaattggtcacaaattgctgataatgacgcatttcttggacactcataccacttctcagcttttcttctttgcttttttccattaattcttttttactcatattttcatagagcttttcagcgacttgctcaaatgccgaaacggattgttggtacgctgcgagtgacttgtctttttcactttctttcagttctaagagcttttgaaatttgtattgatatctcactgttttcgtcaatcctctctattcatcaaaccgagcaatacattcacactgtcttcaatagatacagcctcttctacatcctgcttcaaaaatgaaatcagatgaggataagcctgcatagcatcatcaatgtctttcgaggagccttttttatatgctccaatgttaatgaggtcttcagcgttttgataagtggataaaagctggcggaaccggttggccgcctccttgtgatcatgacttgcgatattgctcatcacgcggctgatacttttcagaatattgacagcgggaaattgtcctttgttggctaaagcacgatcaagtacaatgtgaccatctaagattcccctaactgtatcagcgattggctcattcatatcgtccccatcaacaagcactgtataaaacgctgtgatggaaccaagctgattcgttccagttcgttcaagtaattttggcagtatagcgaacaccgaaggcgtatatccttttgtcgttggcggttcaccagttgcaagaccgatttccctttgtgccatagcgacccgtgtaacagagtccatcatgaacatgacattttttcctctgtctctaaaatattccgcaatagctgttgctgtataagcagccttcattcttgtcagtgcaggctggtcagaagttgcgacgacaacaatcgatcgctttagtccctcggtacctaaatccttttcaataaactcacgaacttcacggccacgctctccaacaagagcaatgacattcaggtctgcttctgtctgcttagcaatcatccccattaaggtacttttcccaacaccacttccggcaaaaataccgattctctgaccagtgccgactgtaagcagactgtcgatcactctgacgccaacgcccattttttcacgaataggcggcctgtccatcgggtttggaggtgactgatctgtcgaaacaggtgcaagtccctttggaagcatactgccgtccagcggttcaccgaaggcatcaacaacttcgccaattaagccagttccaactttgaccttcagcgactcacctgtcgcttcaactagactccctggtgaaatattggatgcttctacataaggcatgagcagaatatgttcatctctaaaccctacaacctctgcttttatcggatcgtgcttacgcccctttttatgaatgagacacacgtctccgatagaactttccggccccttagattcaatcatcagtccaacaactcgattgactttaccaaatcgtttataaggatcggcagtttcgatcgtttctcttaacacatcgatgttcatttgtgctcacctgaatcaatgacttctagcagctttcctttcaactgattcatttgggtatcaacactcgcttccacttttccaaagcttgtttctacgtaacaagtcccttttggcgctttttcatccgagtaaatcgcaaggtgtgtatccttttgaaggattctgattaattcgtctttatactccatcacgtgatcgtaatgtttagggtccacatagatggaaatatcgtcatattctttcacttcagaaatgacctgcttcacgagagccaaaaattgatctttcgtgtcctcagccgagtaccaaacgcgtttagcgagttcaaaagccagttccacaattttttctgcggagctttcaattttttcttcgtaatcctgcttggcaagactgacaatgtcatttgcttgatcaagaattgatcgatactgactcatcgcatctgcttcacccttttggaagccatcttggtaaccagcttgtttcgcttcttcaatcagctgcattctttcttcttcaaaatcagcacggcgctgattgatttcagccattgttttttcaagctcattatttgcttgttttactatacggcttgcttgatcttcagcatcacttagtacaagctgcgatgcttctgtttcattgacaagctcttcttcatgatgttcttttttgaactccacttgctgcaaaggaatcgtttgccggccttgctcaggaataacagatgtttcatgtttgataatcctagacaatgatatcgtctcctccgcccctagctatgacgatttctccagcttcctcgagtcgtcttacgatgctgacaatacgggtttgtgcttcctcgacatctctaagccggacaggtcccataaactccatttcttctttgaacgtttcgaccattctctgtgacatgttgcggaagacaatttctttgacctcttcgcttgccactttgagtgcgagcaataagtcatcattttcaacatctctgatcacgcgctgaattgctctgctgtcaagagtgacaatatcttcaaagacaaacatacgtttcttaatttcatcagcaagctcaggatcttgaatttcaagagtgtctaaaatggtcttctcggtcgcacggtctacaccatttagtacttctacaaccgcttcgactccgcccgtttgcgtatagtcttgcgtaaaggttgaagaaagcttttgctcaagaatgcgttccacttcattgatgatctctggagatgtgcggtccattaaagcaatacgtctcgcaacctctgtttgtacatcctcacctaattcagataatatctgccctgcttggactggatctaagtaggaaagaatgagcgcaatggtttgcggatgctcatgctggataaagtttaagatttgttctgggtcagccttccgggcaaaatcaaacggtttcacttgaagcgaggatgttaaccggtttaagatgctgtccgctttgtcctcaccaagtgctttttcaagtacttgtcttgcgtacataagaccgccttgtgatatgtagtcctgcgcgatggcgatgctgtgaaactcttcgatgatttcatcttttttagcagtatctacacttcgtacattggaaatttcaagtgttaatttttctatttcgtcttcagacagatgtttgtatacagatgctgacacgtctagccctaaggaaatcattaggattgctgctttttgtctgcctgttagtcgatttggatcttttctcgacatgtgtattcctcctaatcctcggacagccagctgcgtagcaatttagcaaagtcttctggtttatcttttgccattttctcaagctgatttttcctcaccatttcctctgtttctggttcagtgtcaatatcaggaacatggattggtgtacgttcatcaaactcaaactcttcttcctcttcttttctgcgtttacgcacaagaagaacaatgagagcgataattgcaagtagtagcacaccgcctacaatataaacccagattggaatattgtttgatgggttttctgctgcagtttgctgtttaccgtctaattttgatacagataaaacaattttgttatctaagtctgcttgagtgagcgcttgaccatttgtgtattctttatcaattgacgtgctaatgatcgttgaaagaatctttttaatatcatcttgcctttcagctgttaaagagttcacatcgtttgcagttggtggttcgaccaatgcttgaatgccaacatctctaattttataagggctctctttgatatctttatgaatgcggttgacttcatagttgatacgatcttcgctcttttcgtaatctccgctaccattcgctccatcggcgccttgatagtttgtgacatcatcgtcgcctgttccagcggttccaccagctgctgcaccatttcctgaataagtttcagcaatcttttcagcactgacagcgatgccttgcatgttttctttatcaactggttctacaagatcttcttttcttttctcttcagtaaaatcaatgtctgttgtgaccgatacagcgactttttcttgacccatcattgttccgagcagctgttgaatttttctttgaaggttcttttcaatttcttctttcttctgctgctgtgcatccattccacttgcataggaatcagaactgctgtttaagtcgtagtagttggaatcttggtccataatgacaatgttttctgtctttaaattcggcacactttttgaaataagatgataaaggccttttacttgctgcggcgagagcgtgtagccacgttcaacttgcagcacaatggatgctgatgcattactttgctcttctccaacaaaaacggaatcttttggcaggttaatcataacttttgaatctttaatcccatcaatcgtgttgattagattggatagttctgtctgggttgcgtctactttcagaacatcaaattcattatctgttaaaccgaagccggaattattcgcaaaaaatgagtagtcaatattccctgtcttagggagaccctcagatgcgagtgttacttttaaagagtcggcctgcttttctggaacgagaatcgttgttccattattcgcaagttccgatttaacgtttttgccatctagttcctgtttgatttgtccagcttctgcctcagacaagtctctaaacaatggaaccattttttcagaagaagcaaagatgctaacaaccgtaataatgattgctagggcagcaacgccgccaatcataagtattttttgtaattttgatcgatttcgccaaaactcaactgtttttgttcttaattgcattaaagtacgattcatcttaacccccggtcattccattcagtctttttttgtccgtcagcacctcctacatctgcattctcataatctcttggtacgcttcgactgctttatttcgaaactccgttgcagctgtgagtgtcacactcgctttttgcgaggcaatcatgacttcatcgagattgacatcttttccttgtgcaagtgcatttgtatactggtctgatttcagctgcgattgatttaatgcctcaatggaattcttcagcacatcagagaaattcgtttgacttttaggtgcagccgcatgaacggacgatgcatttgtcaattcacttgcttgctgagcagtttgaagctggaaaggagatattgcgttaaccaattcttttcaccttactttcctatttctaaagctttcatcaacatgcttttattcgcatttagtgcggtcacgtttgcttcatatgaccttgagctgctgatgaggtcaaccatttcctttaatggatcaacattaggtgtttgaacatatccattttcattggcatcgggatttgtaggatcatattgaaggttgaatggagtttcgtcttctgtaatcttcgttgctttcacgccgtttcctaatttactgctcgaattcatacttgagtttaatatagatgaaaacgattcacctgacggctgtaaggtgacgagcttacgtctataaggctcccagttgccatcaacctgtttcgctcttgttgtatccatatttgcaaggttagaggatacaacgtccattctgagcctctgtgctgttagtgcagaggccgaagcgttaacgcctgaaaaaattgacatcacttacctcctgtcaaaactgttttaagagaattgaattttccactcattctttcaaccaacgcattatactgaatttggtttttagcgagttcactcatctcttgatcaatatcgacattatttccgttttcttgatatgaagtacggttgctcgaaacaactgaataattagaccctgttttagaaaaatcaatgtgaccttggtatgtttttttagcatctagcttgatcgacgcatcgtttagcatatcatgaaatgcgacgtttttcgacttgtagttcggtgtgtctatattcgcgatattattgcttatgactttttgcttaacattcgctctgcccaaggcattctcaaggttgcttatcgttccagaaaatatatccaaaaccatatacctccaatcatatgtatttcattccatttaatcatgtcgagatttgtaaaaccatatgttcattgtaagaaataataggattaaagtctatgatgtatatgtaaaaaaaactcgtaatatatatctattttacgagtaggtacaaagacctagattcaaagaactaagaattgtaagggttttcttggaaaaaagagtgtcatttttcggacaaatcctctttttttataaaaaaaaaccctttttagcttgtatttctgctaaaaaggggttttgattaatgagattttaaattttcaagttcaattaaaaatttgttgtttaacactttgatatacgttcccttcattccaagagagcgagattcgatgacgccagcactttctaacttacgtaaggcgttcacgatcactgaacgagtgattcctacacggtcagcaattttacttgccactagaagcccttcgttgccatcaagttcttcaaagatgtgttcaatggcttcaagctcactatatgaaagagaactaatcgccatttggacaactgctttacttcttgcttcttcttcgatttcctctgacttctcacgaaggatctccattccaacaactgttgcaccgtattcagcaagaattaaatcatcatctttaaatgtatcttgcaaacgagacaggattaacgttcctaaacgatctcctcctccgataattggcacaatggttgtcaaacctgattcaaataaatcacggttctcaatcgggaaagctgtatactcactgttaatgtcaagatttgaagatgtttcagggatgttgaatagactctttgtatattcttcagggaattgacggtcttcaagcattttcttcatacgcggattttcaatctgctggttgatcgagtagcctagaagcttccctcttctgcttaatacgaaaatgtttgaatcaatgacatctctcaatgtttctgccatttccttaaaattaactggtttccccgctgaatcttgcagcattgagttaataatccttgttttttgtagtaacgccatgttaatgatcctcctagattactttattcatttgttaaagtataaattgacttaagtctttgttatttgcaatctttcctagcttctcttctacatactgaggggtaatggtcactgtccctagtgtaatatcaggcgcctcaaatgaaagctcttcaaggagcttctcaagtatggtatgaagccttcttgcaccgatgttatctgtctcctgattgacatgataagccacttctgcaatcttatgaatagcatcgtcagaaaattcaagagatataccttctgtttcaagtaaagctttatattgctttaataatgcattatctggttccgttaagattttcacaaagtcttcgatacttaatttatctaattctacacgaattgggaagcgtccttgaagctctggaatcaaatctgatggtttcgccatatgaaatgcacctgctgctacaaaaagcacatggtctgttttcactgccccatatttcgtcatcacagttgacccttctacaatcggtaaaatatcacgttgaaccccttcacgagaaacatctgcagatgatgcaccaccgcttttggcgattttgtcgatttcgtcgataaaaataatcccttgctgctctgctttatagacagcttcttgactgacttcatccatgtcaatcagttttgaagcttcctcagctgttaacgcctttcttgcttctctgacggtcaactttctgcgttttttctttttaggcatcagattgccaagcgcatcctgcatgttcatgcccatttgctccatacccgagccctgaagcatatcaaacatggatggctgctgctcttcgacttcgatcgtgacgtaatgatcttcaagttcgcccatcgccagctgatgagcgattcgctttcttgtcgattcaagttctacttcttcacttgattgatctcgatcacggtcatcttcatcagacccaccaaacagcatctcaaaaggatttttcacagactggctttttttcttgccaggaacaagtaaatgaacaagacgtttatttgcttgtttttctgcctcttcttgaacgtctttcatcttttcttctttgacaattctgatcgctgtctcaactagatctctgaccatcgattctacatcacggccgacgtaaccaacttcagtaaacttcgtcgcttccactttaataaaaggcgcaccagaaatttttgcaattctgcgggcaatctctgttttccccactcctgttgggccgatcattaagatgtttttcggaacgacttcatcctttagcttatcatgtaaaaggcttcttctgtaacggtttcttaaagccaccgccactgcttttttcgcatcaagctgaccaataatgtattgatcaagcttttcaactatctctcttggggtgaacggctttttctccatacgtctcatgtcctttctattcaagctcttctaaagtgatttgatcgttcgtgtagacacagatttctccggcggtttcaagagcagcctttgcaatatctcttgctgtgaggtgatcacctgcatgtgttttgagtgctctcccggcgctaagcgcataattgccgcctgagccgatggccaaaataccgtcatctggttcgatgacctctcctgtaccagagacaagcaggatgatgtctttgttcataacgatcagcatggcctcaagctgcctaagcatcttgtcactacgccactcttttgctagttctacggctgccctctttaagttaccaccatattcttcaagcttcgtttcaaacttttcaaagagtgtaaatgcatctgctactgaacctgcaaaacctgcaagcaccttacctccgaaaagacggcgcactttttttgccgtgtgtttcatcacgacagcctgcccgaaagtgacttgaccgtcgccagccatcgcactttttcctttatgttgaacggcaaagatggttgttgcatgaaatgatgacatgaaaaaacctccttttaggatcgtttaaaagcccttgggtgatgagacatgtacgttttccttaaagaatcttttgatacatgcgtgtacacctgagttgatgataaattcgaatgaccaagaagttcttgaacacttctcaaatctgctccctcatttaagagatgtgtggcaaaggtgtgccttaacatgtgaggatggatatgtaatgtgcctgacgcctttttcattagttcagtgagaatgaatcgaacacctctgtctgtaagaggcgccccgcgctgattcaaaaatacatatgcatcagcacgatcattccccttcgctttcagcttcagccttccatcctctaaataagtgatgagtgcttcatgagcatatgaaccaaaaggaacataccgctgcttgctgcctttcccatgaacaagcactgtatccatcgataaatcaagatcagattcttttaatgaacataactcactgaccctcatacctgttgcataaagaagttctaaaatcgcttggtttctttgcccaagcggtgtactgacatcagaaacagtaaaaagctctttcagttcctcttcatacaaaaatgaaggaattcgcttatcctgctttggtaagctaacgagtaaaaaaggattttctttcacaagctgttctcttaatagaaatttataaaagctgcgaagcgcagagactttcttactaatcgttcttcttgtcaggcctttttcataagcttctgttaaataaattctcgtatcttgataggatacctcttcaaaaccgtctattccttgaacgttcataaatctgacaaactcttcaatcgcttctgtatatcctgagatggttaaaacagaatagtttttttcaatttgcagatattcaatgaataagtggacaagacgctgtttattcgtcatttttacacctctttaaggcttttaaatggtatcacatatcttgctttccttgcaatgttttactacagagatttcgaaatagtttgaatagtttcgattgcgcgcttagcgtactctgcataacgctcttgtttgtttttaatgcgaacaccaagatctttcaacaagccaaaattcgcattcattggctggaagcttttcttgtttgtcgatgtgatgtaataagccatgctgccaatcgctgtttcctccggaagagtcacaagctcttctcctttgacaaaacgagcggcgtttataccagcgactagtccggaagctgcggactcgacatagccttcaacgcctgtcatttgtccggcaaagaatagatcttctctatttttaaactgatacgttggttttaaaagactcggtgagttaatgaatgtattgcggtgcatcacgccataacgaacaatctctgcttcttcaagacctggaatcaagcggaatacttctttttggtcgccccacttcagatgtgtctggaagccgacgatgttatataaagtacctgctgcatcatcctgtcttaattgaacaacagcgtaaggtctttttcctgttttcggatcttcaagtcctactggcttcatcggaccaaacaacatcgttttctttcctcttttcgccatgacttcaattggcatacagccttcaaagaagatttctttttcgaactcttttaatggaactgtttcagcagaaataagcgcctcataaaaacgatcgaattcttcttctgtcattggacagtttaaataagcggcttctcctttgtcataacgtgatttcaagtacaccttatccatatcaatgctatctttctctaggataggtgccgctgcatcgtagaagtatagatactcttctccagttaacgattttaattcttttgaaagtgcttcagaagtaagtgggcctgtcgcaataattgttgggccttctggaatgctttgtacttcttcttgaaagactgtcacattcgggtgattttttactcgatcagtaacgtttgctgcaaattcatgacgatctactgcaagcgctccgccagcaggaactgagctttcatctgcggctgcgataatcgctgaatctaaatgacgcatttcttcctttaatacaccgaccgcatttgtcaaagcgttggcacgcagtgaattgctgcatacaagctctgcaaatttatctgtgtggtgagctggcgtttgtttgacaggtctcatttcatataagttgactttaattccgcgtttagcaatttgccatgctgcttcacttccagctaaacctgctccgatcacatttacaaattgactcattgtacaactctcctatttcgtaagttctgtttgatgacataaaaaagcaggtgaacaaggttgctcaccgctatttttgttgttcctctttataatcacagttcacacattgaacttgcatgccttttttcagctttttctctacaagcatattttcgcattttggacactttctttcaatcggtttgtcccaagagacgaattcgcactctggaaaacgatcacagccataaaaaatgcggcgcttcttagattttcgttcaacaatgtttccttcatgacatgttgggcatttcacaccgatgtctttcacaattggttttgtgttacgacagtcaggaaagttagagcaagccatgaacttaccgtatcgacccattttgtacaccattggatgtccacactcttcacagtcaaccccggcgtattcaggctcaatctcaacttcttgcatttctgcttccgctttttctacccgttttgcaaagtcttgatagaagctgtcgataatgcgaacccattcgatcgtaccttcttcaacgctatcaagttctttttccattttcgctgtgaattccacgttaatgatctcagggaagaattcaatgattaagttgagaacaatttccccaagctctgttgggataaaccgtttattatcaagtgcgacatagccgcgcttttgaatcgtgtctaatgttggtgcatacgtagacggacggcctattcccagctcttcaagcgttttgacaagtcttgcctcagtatagcgtggaggcggctgcgtgaaatgctgttcaggttcgatatcttttgaaagaaccgtatcaccttctttaagatcaggcagcattttgtccttttcttctagctggtcgtctttcccttctacatataccttcatgaatccagggaatttcactttgcttccgttagcacggaatgtaagcccgttattatcaaggtccacactcattgtatcaagaacagccggcgccatttggcttgcgacgaatcgttcccaaatcaatttatacagacgaagctgatctcggcttaagacatgtttgacatctgctggttttctcagcgtagaagtcggcctaatggcttcgtgagcatcttgtgcattttcattctttttagcggttcgttttgttgtatttaagaaattcttaccgtacgtctgatcaatgaaagcagatacttcttcaattgccgtattggaaatacgagttgagtctgttctcatgtatgtaatgagtccgactgtaccttctttaccaagatcgattccttcatataattgctgtgcaatcatcatcgtctttttcgcacggaagtttaattttcttgcagcctcctgctgtaaagtagatgttgtaaacggaacagctgggtttcgtttacgctcttttttcgtcactttctctacagagaatttgctcccttttagtttcgaaaggatttcttttacatcttcttttgttttcagtggatgctttttgccattgacgccaaagaagctcgcttcgaagctttcttttccttttaggaatgtaccgtcaattgtccagtattcttctggtttaaattcattgatttcattctcgcgatcaatgatcaggcggagtgcaactgattgaacacgaccggcacttaagccctttttcactttcttccataaaatcggactaattttatacccaacgagacgatctaagatccgtcttgcctgctgtgcatcaactaaatccatattgatcatacgtggatgcttaaaggaatctttaatagcatcttttgtaatctcgttaaagacaactcggcagtcagacgagaggtcaaggtcaaggctatgcgctaaatgccaagcaatcgcttctccctctctatcggggtcagctgcgagatagactttctttgcttttttcgcagcggtttttaattcttttaatacggggcctttcccgcgaatcgtaatatacctcggttcgaagtcatgctcagtgtcaacaccaagctgacttttcggtaaatctcttatgtgtcccattgaagcctttactttatactttttacctaaataacgctcaatcgttttcgccttggctggcgactcaacgatgactaaataatcagccatactcaaaatcccccttaagaggtgttctctctttatacatttcacaattcatatttatgttaattgcacctatctaacaggcaatcatgaaaaattctttatgatgaacatcattataaacacgaaaaacaaagtgtaaacttaaatcctcactattattaaatattcctatgtcttttgtcaaacgatatttttatgagagttcagtatattgaacaccgcggaaggagaattcctctaaaatatccttcgttgaatgaacaagctttgctccctgctgtataagtttggctggacctgtggaattaggatcaaagattgatcctgcaaccgcaaatacctctttgccttgctcaagtgcttgatacgcggtaatgagtgaaccgctcttttctttgcactgaatcacgatggttccacttgttagcgcactaattaatcgattcctcaaagggaaatgccacttttctggtttgacataaggcggatgctcagacaaaagcaaatgatgctcgcccatgtattcagccatttgcacatgttcctttgggtataagtgctgaaatccgcctgctataataccaatcgttttccctttattcctaatgcactctttgtgtgcgattccatcaatgccttttgctaagccactgacaatcgtccaatcttcctttacaagctcaccaacaattttcttcacacatgcttctccataagacgatggaactcgtgtgcctactacacctaaacttttttcttcatttaaatatgatatgtttccttttaggaataacacagggggaggatcataaatatgttttagtgtgctgggatataagggtgatgtgatgggaatcatgtgaatgttttgctttaaataggcttgaacgatgtgttgaaaaatggggaattctttttcttcggcttgttttaagcgggtaaagtcgattgtttgtaatgatcgatcctgtttgaaatgatgtgtttcttcatttatatatagctcaggatcgactttccaccattttgttaacaaagagggtgagatgaggccttttaagcggtgaaaaatcattctttcggacacgttgtacatacaattcctcctgtttaagatagaaagaagaagacttgtcaaagaacaagtcttcttgtgtcattaatgcgttttacaagcttcaaaaagattcttctcttttagtactttaatcaatgtttctcccatgacagatggtgtctctgccacttcaattccacattcacgcattgtttttactttttcatcagctgttcctttaccaccagaaataatggcaccagcatgtcccatgcgttttcctggaggcgccgttttaccgccaataaagccaacaactggctttgtcatatttgcttttacccattcagctgcttcttcttcagccgtaccgccgatttcaccgatcataatgacagcatgtgtatcagggtcttcattgaatgcttttaatacatcaataaagtttgtcccattgacagggtctccgccgattcctacagctgtcgattgaccaacgccagcttctgaaagctgatgtaccgcttcatatgtaagcgttccagaacgagaaacaacacccacatgaccttttttatgaatgtagcctggcatgatcccaatcttacattcttcaggtgtaatgacacctggacagttagggccaacaagtcttgtctttttcccttccatataccgttttactttgaccatgtcaagtactggaatatgttcagtaatacaaatgactagatcgacttctgcatcaacagcctctaaaatggcatctgctgcaaatggtgctggtacatagataacagaagcatttgctccagttgtttgaacagcttcagatactgtattaaatacaggaactccttctacttcagttccaccttttccaggtgtgacaccgccaacaatatttgttccgtactcaatcatttgttttgtatggaacaatgcggttgaaccggtaatcccctgaacaattactctcgtatttttattaataaatacactcatttaggttccctgcctttctgctctacttgactaaagatacaatcttttctgccccgtcagccatagactcagcagaagtgatatttaagcctgaatcgctcaggattttcttccctaattcaacgtttgttccttcaagacgtacaacgagtggtaatgttaagccaacttgtttcgttgcttcaacgacaccttctgcaatgacatcacatttcatgatgccgccaaaaatgttcacgaaaatcccttttacattttgatcagataagatgattttaaatgcttccgttactttttcagctgttgcaccgccgccaacatccaggaagtttgcagggtccccgccgtaatgcttgatgatatccattgtagacatcgcaagacctgcaccattgaccatacagccaatatttccatctagagaaatgtagctcagatcatatttagatgcttcaatttcttttggatcctcttcatcaaggtcacggtattctaatatatctttttgtctatataaggcattgctatcaaagtttaatttcgcatcaagcgccatgacttttccatcgcctgttacaacaagtggattaatctcagcaattgaacaatctttttcaatgaacgcattgtaaagacttgtcataaacttaacagcttggccaactaattttgttggaatattaattttaaacgctacttctctcgcctgataaccttgcaatccaatcgctgggtcgatgaccactttgacgattttttctggcgttttttctgctacttcttcaatttcagtaccgccttcttcagaagccatcaacacaattcttgatgtcgctctgtccaaaacaagtccaacgtagtactccttttgaatatcgcagccttcttcaataagtaagcgttttatttcgcgcccctctggcccagtttgatgtgtgacaagtgttttgccgagcaattcctctgcaaaccccttcacttcatcttttgtttttgcaatttttaccccgcctgctttaccacggccgcctgcatgaatctgtgcttttacgacatatacagagctttctagctcttctgatgctttcactgcttcatcaggtgtaaatgctactttaccatttggaactgaaaccccatattttcttaggatttcttttccttggtactcatggatattcatttcccatcctcccaacatatgtagaaacaaaaaatataaaatagactgcgctttcattttaaagaataaaaaagagaatgtctagggttctatgtaaaatcgtaaaatccttctaaacattcaaacttttattttattaaaaatataaatttttcatccaaatcacttattttaccttattttttcattttttgatctaacctatagataaacgaaaatatttctgctacagtatcgtataacgcttcagggatctcctcatccagtgttaaatggcgcatgagttcgactaaattacggtcttcttggataggaactcccgacttttttgcttcttcaataatatggtctgccacatagccgctccctgtcgcgaccacttttggcgccttttgtttttcttcatcataatgtagagcgaccgcccttctaagcggttttgaatccttcatactcgtaagtccagccccttctcgctgattttatgaaagtgttcatctagaaagtgagacggatctactggctcttgtctcttctttgctgtaattcccgtgaggctgtatcctaatgcatttaaattctcccgaacagctggaatcatcggattaatggttccttgaagttcatgaccggtttcaactgtaattgacatgaccttttgctgaatcgtacagtcgattaatgtttcttcgaggttttccatgtttaagtaaaacataaggcgacactgagaaatatcaatagagccatcttttttcttatgtccttttagaataaaggttaaatcttgaacactatgttttgaaaagagcggataagagaccatcatttggctgatagtttggttctcctgctgcacaaataactgcccgttcaatctatgaaacaattgatcgacttctttttttacgggctctggtaaatcagactgtctcacatcatttaagacgagctttaattggtgaagctcctgactttttgcatcttggttgcctttttcgagtagtttcagcataccgatttcgtcacgtacacctattgcctttttcatcgtcatgagtaaatcgagcacgtcggttttattgcttaatgcgggttctgtctgttgcacgacctgagccaatacttttgcttctgtttttgacaagaacggaaattctttttgaagcacagatgcttttgcgtcaggctgagatccagcctgctgaagtccttgcagcaatgacgtaagctgttttaagctaggctcttgctgcccatctgcaccttgttttatcaaacttgttagtatccgctcgatttgctgaggcgggatttgcagctcttttggacttgttgattgctgcacgttagattgaagaacttgggtcgtctgacgctcttgagctattggattctgactattttcttttggttgagacagattggactgaggcgttacaggtagatttcctccttgtttcgccgtcccttctctcgctgctagaaggaccgataagagcttttctgcatggacagtcgtctcagcacctatgactgatcgaacggcttgtgtaagggcctgtgtggcgtctgagtgcttcgggagctgtgttaagcgttctagcagtgctgtcatatcttgatgaagagcagaggatgatttcacggctaaaattgattgaaggactccttcttggatcggcaagtctttctttaaagcaaataggagtgactggagaccttttttcacatcagctccttgaagctgttcgatccacttcactgccgtttttaactctgcttcattgatgacggatttttcttttaaaaaagcagtagctgttaggatgttttctagtccgtttttcagagagagaccttctaatagtttggcagctgcatcctttaatgttttagggtcttgttcaaattgctggactggccttagtttattgaggctgcctccaccctcttgttcaaattggaaccaataaaatgcgtctgctttgagctgagccgctagctgcgcttttatttttgttgagcctatttgaacaagggctgtatcatctccgagcattttcagtactttaccaagaatcagtcgatgcacattttcctttccttcggtgtttaatggcacagattctgccgtattcagccggctattcagtgctgtatgtatgtcctcaactcttgtcatcacaggcagcctccttaggtcaaaaatttatgatataacggatttcactggtgcaaatgataatcgatggattggggtagctccatgtgtttgaatggcagccaaatgctcttttgttccgtaccctttatgtttttcaaattgatactcagggtacttacgcccgtattcttccatcatctgatctcttgtcacctttgcaatacatgcacctgctgcgatagacgcactttttgcatctcctttgatgatattctcctgttgaataggaagcgggagcgtcatggcatctatgagtagataatcgggtgtatgagttaacttctccaccgctctcaccatcgccagtcttgatgcctcgtaaatattgatttcatcaatcgtagctgcatccacaatgccgattccgatatcaagtgcttctttttggattaggtcataatatgccaatctttttttctcagataattgctttgagtcgtttaaaccgagcaggactgtatcttcctttaatatgacagctgctgcgacaacggggcctgcaagtggacctcttcctgcttcatctattccagcaatacatgtgtatccctgcgccttcgcactgttttcaaattgcagcatctcattccatgctgcttgaagttgctgctgcttttctctctctttgcgccacttctctatcagtttttggacactttttctcgtatcatcttttacaagttcatgaatgtatgactcgtcttgcgaatgcttttctatcagttcttttatttgtttcactgtgtacatcagcttttcgtcagcctccttctttatatcggcagttttccgcaaaaaataaagacccgcatgagctgcgtgtcttttagctttcaggcttctcgaaagtgaggggaccaaatttttctgttcgaatatcccgaataatgatttcggtggttttgtcgtaattaataaatccaccgctcatgagacagccgcgctttgtacctattgcatcaaacagctcagccgtatcttcagggatctccgttaggtcatagcgtttttttaatcgctctggatagttttcttctagaaagcgaagtccatatacagcgacatcctgtaagttgatgatagaatctttgatcgctccagttaccgctagcctgagtcctactttctcatcttcaaacttcggccagaggattccaggtgtatcgagaagttccaattctttccctaccttcacccattgctgtgaggtggtaataccaggacggtctcctgttttggcaatgttctttttcgctaaacgattgattaaggtcgatttcccgacgtttggaattccgataatgagcgcccggattgcacgtggtttgacaccttttgctttcatgcggtcgaatttttcttttaagatttcctttgaagttgtgatgatctgatttaacccttgtccatcgacagagttaatagcaagtgaccgaacgccttgctgctcaaagtgcgcctgccactcctttgtcacacgaggatccgctttatctgctttgtttaatagcatgattttgggtttattctgaaggatttcttcgatcattgggtttctagaggacatcggaattctagcatcagttaattcaaatacgatgtcgatgagctttaatttttctgtgacttcacgtcttgcttttgccatatggcctggaaaccattgaatcgtcatatgtgcaccttctcttctatctattatctctatacattgtacaaaaaaagagcctgttacaggtaacaagctctttcctttgatatcattatcgtctgatttctttgatacgagccgctttaccgcgaagttcacgtaggtagtaaagtttcgcacgacgtaccttaccgtgacgtacaacttcgatgttagcgatttttggtgtgtgtacagggaatgtacgctcaacgcctacaccgtaagaaatcttacgaactgtgaaagtttcgctgattccaccaccacgacgcttaattacaacaccttcaaagatctggatacgctcacgagtaccctcgaccactttaacgtgtacacgtaaagtgtcaccaggacggaacgcaggaagatcagtgcgtaattgttcttttgtgatttcttcaatcaaatgttgcatcgttttcaactccttccaacagatgctcatgtcctctttcttcattgcagcggaacatcgttttcaaacttgaatcggcaagccgtccaagtcacaagtagtatcataccatacctctatgcagtgtgcaatacaatctagtcattatgaagctgccaaagccatcttttttcttcttctgttaacgttttgcaagaatcgatcaaatctggccttcttgtataggttcgcttcaaagattctttgcgccgccactcttctattttggcatgatttccagagaggagcacatccggcacttttagtcctttataatcggctggccttgtatagtgaggatgctctagcaaacctgtactaaatgaatcttcaatgtgagacgcttcttttccaagcacatgaggcaaaagcctgaccacactgtctgcaatcatcatcgctggcagctctccgcctgtgagaacgaaatctccgattgagatttcatctgtgacaagatgctccctgatgcgctcatcgtagccttcataatggccgcaaatgaacataaggtgttcttcttttgcaagttcctcggccttcttttgcgtatatctttccccttgaggacagacaagaatgattcggggcttcttgcttgctttcttcgtcaaatcttctaccgcatcgaatacgggctgtgctttcagtaccataccagcaccgccgccatatgggtaatcatctactgttttatgcttatgatccgaatactctctaaaattgacaacattgaatgagacagcttctttctcctgtgctttttttaagatcgatgagtggagcacaccttcgaacatttcaggaaaaagtgttaagaagtcgattttcattcgtcaataagtccttccatcacttcaatgtgtatggttttggatgagatatcgatctttttgacgacagatgggatataaggaatcaaggcatcttttttgccttttcttccgaccacccagacatcatttgcccctggtgttaaaatctctttgatttggccgacaagctgatcctcttcatcgtatacttcacagccaatgatttggtggaaataaaattctccttcatctaaagagccgagatgttctttttctacttttaagattgattctttcaatagctctgcttcatttaatgagctaatttcttcaaatgtaagcaaatcaaactgtttatgctgccggtgtgatgcgacagtgacttttagcggctctccttgaccttgcttaaaaatatagaggacgcttccttttttataacgctcttctgggaaatctgtctttgacacgacgcgcacttctccgcgcactccgtgtgtattgacaatctttccaacattcaaccattcctgttccatgttctcaatcacccctgacgtatttccacaatggtgccgtctttcacgacgatgacattatcttgcatcttgtcatcccatttatcacctattttcacttcaaccagcgcatccacttctgtctctttcatttcacttccaagcggcaaaatatgtagctgctctacttgaaagtcaatttgctggattttctcttgccgtttatcgatggctttttgaaattgagggatggcttcttgctgatgtggttctttttcatgttttttcagttgaaaatatagttgattgcattcacgttctagtctttcttttttctccaaaaaagtcgttaacagtttgtccttactgctttcagttaatacttgcatgacggtgacatgttgaatgatctgcatcttcctttttgtccccctatccgaaggcatttgtcctctacagtataacgaaaaatagatttaaacgtgtaaaaaaaggggaggtcctaagccctctccctttttagtcagcaatctcaagttgaactttcttagaagactctgcacttgctgcaaacatgactgttcgtatcgctttcgctgtacgtccctgctttccgatcacctttccggtatcttcagcattgacagacagtgtgtaaatcacttgctcatctttttctaatgaagatacgtgaatatcttcagggaaatcaacaagtggctcgacgatggacacaatcaattcttccaaggacagctcattcattatttgctgtttttcgcattatgaaatttttcaagaattccttggcttgagaaaaggttgcgaactgtatcagatggtttcgcaccattttgaagccatttaagagctaattcttcgttgattttcacctcagctggtgataaaactggattgtatgttccaactgtttcgatgaaacgaccgtcacgtggtgaacgagaatctgctacaacaatacgatagaaaggagatctttttgatcccatacgttttaaacgaatttttactgccattttactagcacctccgaaaatatttcaacaagatagtatattaacaatgataaaagggtttgtaaagtgttttttcttaacaacagttttatcatgtataaccaattacataaatggtaatttaaagccttttttcttccctttggacatgttggtcatttgcttcatcatctttttcatttcgtcaaattgctttaaaaggcgattgacttcctggacagatgttccgcttccttttgcaatccgttttcttcggcttgcattgatgacctctggctgttctttttcctcggtcgtcattgatttaatgatcgcttcgatgtgattgagctgcttttcgtctacttgaacgtttttgagccctttcattttaccggcacccggcatcatttggatcaattcatcaagtggacccatgttacgaacttggccaagctgctcgaggaaatcatcgagtgtaaagctcatggtccgcattttttgttcaagctctttcgctttatcttggtccacgtttgcctgtgctttttcaatcagtgtaagcacatctcccatgccaagaattcttgatgccatccgttctgggtggaatggttcaatcgcgtcaagcttttcacctagcgcggcgaatttaatcggcgtattggtcacagctcgaatggaaagtgctgctccgcctcgtgtatccccgtctagtttcgttagaacgacacctgttaaaccaagctgttcattaaagcttttcgctacattaacagcatcttgacctgtcattgagtcaacaacaagaaaaatttcttctggactcgctacttcttttactttctgaagttcatccatcaattcttcatcaatatgaaggcgtcctgctgtatctaaaatgacataatcatggtgttcttctttcgctttttcgattgcctgtttggcaatctcgacaggactgacttgatcacctaatgaaaacacaggcatatcaagctgtttccctagcgtttgaagctgctggatcgctgctggtctgtaaatatctgcagccaccatcatcggcttgcgattatgttttttgcgaagtaaattggcaagcttcccagttgtggtggttttaccagccccttgaagaccaaccatcataatgaccgtcggagattttttcgctacagcgattttactctcttctccgcccattaattcagtgagttcttcttttacaactttaatgacctgttgtccaggggtaaggcttttcatgacctcttgtccaactgcccgctcacttacttttttcacaaagtctttgactactttaaaattgacgtcagcttcaagaagggcaaggcgtacctcgcgcatcatttcttttacatcttgttctgacacttttcctttgccgcggatttttgaaatcgtctgctgcagtcggtcggctaatccttcaaatgccatactgtgccgcctcctaatctaatttctcaagcgattcaattaaagcttctgcttcttccgtctgtgcggaatctgctacgagctctctcatttttttgagaagttctttacgctctttaaatttcttaaacaagagcagcttttcttcatattgttcaagcatcgcttcagtccgtttaatattatcataaacagcctgtcttgatacttcatattcatccgcaatttcaccgagggaaaaatcgtctaggtagtaaagcgacatgtagctcttttgctttgcggttaacaacgattgatagaagtcaaacaagtagttcattctcgttgttttttcaagcgtcatgggctctctcccctttgttaagttcattccctttacatcaactaagtttacacggttctctactgtgtgtcaagtttttatcttgtcacttcatgaagcggcgtataaataaaaatgccagcagtttttgccggcatttttgttagtcttcttgatcaatcacgtctgagaatagtccatacacatacgattctgcatcgaattcttgcagatcgtctaccttttcacctaaaccgacgagcttcacgggaatgttcagctcatttcgaattgcaaggacaatcccgccttttgcagtcccatcaagctttgttaaagcaattcctgtcacattcgtcgctttagaaaattccttcgcttgagccatcgcattttgacccgttgttgcatcaagagcgagcagcacttcatgcggtgcatctggaacctcacgttcaatgactctcttgaccttctctagctctttcatcaagttgactttgttttgcagtcttcctgctgtatcacagataaggacatccgcatttttcgcttttgctgattgaacggcatcatagatgaccgctgctgggtcagagccagccgtttgtttaacaacagggacacctgaccgctctccccatacttcaagctgctcaatcgcaccggcacggaatgtatcacctgctgccaaaataacagatttcccttcatttttcagcttatttgcaagtttgccgatcgtcgttgttttcccaacgccattgacacctacaaataaaataatatttaatcgcccgtcttcaatattcagcgcagagatttgttcctctccgctattgtagatttcaaccagtttttcagaaatgaccgattgtacttcacttgggtcttgaatgtttcttaatttcacttcttttttcagctcatcgatcagttccatcactgttgtaaaaccgacatccgcgccgattaaaacctcttctaattcttcaaaaaagtcttcatcgactttacggtagcgagaaattagttcgtttactcttccttgaaaggagtttctcgttttttcaagtccatctttaaacttttctgatactgaatcggtttgctgcgtaaatttttcttttaacttcttaaaaaagctcatttggttcaaaaacctcctttaattactggacaagctctttcgtttcttctagtttgacggatacaagtttagaaactcctgactcctgcatcgtaacaccgtaaagcacatctgcttcttccattgttcctttgcggtgcgtaatgacaatgaactgcgtttcctcgctgtatttctttaaatattgcgcaaagcggaaaacattggcttcatcaagcgccgcttctacctcatctaacacgcagaatggaacaggtctgacttttaaaatagagaatagtaaggcgatcgctgtcaatgctctctctccgcctgaaagcaggcttaagttttgcagctttttccctggcggctgcgcgacaatttcaacgccagagtttagtaaatcatttggatctgttagcttcaggtctgctcttccgccgccaaataacgcttggaaaactgattcaaaatgcccgcgaatttgcgagaatgtttcagagaagcgctttgtcatctcttgatccatttcttcaatcacttggaataatgtatttttcgcttctgtcagatcatttcgctgttctgttaagaaaaggtagcgttcatttactcgttcatactcatcaatgctgcctaaattgactgttcctagctcttcgatggctaatttgatcagcttcactcgttttcttgcttcatctggcgatagcgttagatgatacatctcttttgccccttcaaatgaaagagcatactcttcgttcaaataagcgatgaggttgtcgagctcaacctccatacggccaagcttaatttcttcatcttttaaacttgtggtgagctgtttataaaggcgtttttgttctttcagttcacgttcagcaaattctaacgtttcagaaagagcaagacgctgtttacgccgctctgaaatgagtgcggttgttttgtttttgttttccagcttctctttcgccgcttcttccaactgttctgctccgcttgagctagacgtcatttcacttgttaaaagtgacagatcttctttggtttccgtcagcgtttgttcagcctcttctaattcggctattaagctcgaaagcttttcttgttcgttcgctaaggactgctcttttttggcaagtgagattttcagctcagttaattcggcagaaatagtttctttcgttgagctttgggtctgcttacgctttgttaatgtattgatctcttgatcaagggtggtcaatttctcccctatagaaacttcaagagctgcctgctctttgtccttatctgtcagttcagtagaacgcagctgcaattcttctttttcttggtcatagagttcaaggtgagcattaatatttttttctgctacttgcagttcgtacagcttccctttgagctcttgctgctgttctcgaagcgtttctccccgctgacgcagttcgtttaattggctttcgtttgctgcaatcaattgcttcgtttcttttgtttccttttcaaggatcgttgttttttcttccatttcaacgagctgctttgttaatgtttcaatctcacggtttcttgaaagaagggagttgttctttttcttcacaccaccaccggtcattgaaccgccggggttcacaacatctccatcaagggtcacgatgcgataacgatgaccaagcatttttgccagttcattggcaccttttaagtctctaacgattagaaccgttccaagcaagttctgtatgaccttttgatacttttcatcaaaggaaacaagttgactcgctacaccgataaatgcagcatgctgctcagctgtttggacgtctctatgctgaatggttctttctttgatcacattcattggcaggaaggttgctcttccaaaggagtgctgctttaagtatgcaattgcttgtcgcgctgcggattcattttctgtaacgacgtgctgcgttgctgcacctaacgcgatttcaatcgctgtctcatgctgctgatctgtttgaatcagctctgcaatggcaccgtgaataccgcctaaccgttcttttgcctttaagacctcttttactccttggaaaaagcctgagaagtcttcctgcatggattctagcatttctttttttgattttgcctgctgcacatattgataggcttggtaaagagccgtttcttttttctcgtattgacgtttcatttgctcaagcttttgctctgcttccctaaaccgcttgacttgagccaaaatgtcttcttctagggctgaaagctgctgctcagcctctgttttcttctctttgacagatacacgctcttcaatgtgtttttggttgttttgcgtgagccgatccagctgcatgaccgcttggcgctgctgttcttctaataatttgcgttcattgcggatggaagcctgttcattgagcagatcaaaataatcgctttttagctgttcaatttgaccttccacatcttcactatgaagcgacagttgatgctgctttgttttcacttcatcttttatctgctgcacttctttttgaaggctgtcccgcgtgattttctgctgctgaatcttttcggttagctgcgcctgcttttcagttaagcgaatgagtgtttcttctagctgtccctggtttgcggctgcatttttcttccgttcttttagtacttctttttttccttcaagcttttctaattcctcacttgtgaaaagaagaacttcttgcagatcattaattgattcgtcaagtgcttgaatgcggtctcttgactcttcaattttagcttcttttgcttgaatatctgtggattgcttcatttcatcttgtttgaagcgctcgacagcttcaccaagtgttgtccatttttcatgaagtgcttcaatgtcatgaacagttaaggcgatttcgacattttcaagctcttcttttttttgcaaatagtcctttgcaatagacgcctgcattcttaaaggttctacttgatcttctagttcatgcagaatatcttctactcggtttaagttgtcctgcgtttcaaacagtttattctcggcttttttctttcttgttttatatttcaaaacaccagccgcttcttcaaagatgcttcttctctcttctgccttactagataaaatttcttctaccttcccttggctgatgattgaaaaagcttccttcccaagacctgaatccatgaaaagatcaataatatcctttaagcggacagattgattgtttatgagaaattcactttctcctgaacgatagactcttcttgtcacactgacttcgtgaaaatcgatcggtaaaaagtgatcttcgttatctaatgttaaagtcacttctgctaaattgactctttttcttgagtcgcttcctgcaaaaatgatgtcttccatttttcctccgcggaggcttttcgctgattgttctccaagtacccagcggatggcatcggtaatattacttttgccgcttccgtttggtccaacaacagcagtgacccctttgacaaagtccacggtcactcgctgtgcaaacgatttgaatcctatcacgtctaaacgtttgaggaacatgagagtgatcctccttatgtatttaaagtactatcatcttaccatatgaagtgaaaaaagatgatggaaaacagagtgaaatccccctgaatgacgagggggattttattggttcatatgatgtttctgcaatttagcaagtgcttcctgtgcagcgtgctgttctgcttcttttttactgcggccatttccaattccaagcacatctccgcgaagggagacatttgcttcaaattcccggttgtgtgctggtcctttttcatgcaagatacggtattccagtacaccttttccatcgcgctgaacgaattcttgcagctggcttttaaagtccatgacatgcgagaacgctccatcattaattttcggataaacataggcttctaagaatcgttctaccggctcaagcccttgatccaaatagagtgctccgataaacgcctcgaatacgtccgctaagagcgctgggcgttttctgccgcctgtcatttcttcgccttttcctaaaagaacaaggtctccgaaggacagctcatgtgccagagacacaagtgacggttcacatacgattgctgctcttagtttcgttaaatcgccttcactcatcgcaggatatttcgcaaataagaattgagagatggtcaattctaaaacagcatctcctagaaattcaagtctttcattatcctcgtatggctttttccggtgttcattcacataagaggaatgcgtaaatgcttgatatagaagtttttcattttgaaaatgtacagaaatgcgctgctggaattctctaaattgctctagttttttgctctgtttctgtttgtctttatattgttttggcatagcaacctccaggtaggcttaatcgcctttaaggatactgattatatggagtctctctttctacatgcaaggaaacattgctccttagcatctgaaaaaggctgacaattgatcagctgaatatgttgaaactaacataaattttgaaagtcccgtcatgaaaatagacgggactttgttacgcttattgctggctatttatgtagttcacagcgtcaccgactgttgcaattttctcagcatcttcgtcagaaatttccatatcgaactcatcttcaagttccataactagctcaactacatcaagggaatcagcgcctaaatcttctttaaatgaagcttccattttcacgtcagcctcatcaacgccaaggcggtctacaataatttttgatacacgctctaatacgtctgccattgcctttcacctcccctcaaagtattatagttgattcgtttttaaaaaactagagaaaacctaatgaaattttgatatttcttaagacatgaccattccgccatctacttggatggtttggcctgtaatataacctgctccttctgaagctaaaaagacaacaacgttgctaatatcttcaggtgcaccaaagcgtgcaagcgggatctgcttgagcatttcagtctgtacattctcatcaagcttgtctgtcatatctgttgaaataaagcctggtgctactgcattgactgtaatatgacgagttgccagctcttttgctgttgttttcgttaacccgataacaccagcttttgctgcaacatagtttgcttgtccagggtttccacatacgccaactactgaagccaaattgatgattcttccgctgcgctgtttcatcatttgacgtgtcacggcttttgtacagttaaagacaccttttaagtttatgttaatgacgtcatcccattcattttctttcattctcataagcaggttgtcctttgtgatccctgcattattgacaaggatgtcaattgaaccaaatgtgtcaatcgcttgcttcatgagcgcttgtacttcttcagcatttgacacatcagctttaacggcaaatgcctgctggccaagtgctttgatttcgtctacgacttcatttgcttttgcttcgtttccagaatagttgacgacaacatttgcaccattctttgccaaatcgatcgcgatagaacggccaatcccgcgtgatgcacctgttacaacggctgttttatttgtaagcatcaagaatcctccttcaatgtttcaatggctgcttcaattgtttcctgatctgaaactgaaatggttgtcaggcggcggttaacctttttcacaagacctgaaagcactttgcctggaccaatttcaataaacgttgtcacgcctaaatcaatcagacgttctacgctttcttcaaatcgtacaggagaatacaattgttcaatgagttttgtttcaatagcatcacgagatgtaacgatgtctgctgtgacatttgagatcactggtgttttggcatctctaatgtctagctttgacagaacatctgtgaatttttcagcggctggtttcattaaggcagaatggaaaggtccactcacttcaagggcaatcgcacgttttgctcctttttctttcgctttctctgaagcgagttcgacaccttttgctgtaccagagatcacgatttgaccaggacagtttaagttagcgagttctacaaggtgaccgctctctgtcacttcttttgtcacttctaaaagcgcagcttgatctaagccaaggatcgctgccatagcgccttctcctgctggaacagcttcattcattaattcgccgcgctttcttacagcatacacagcatcttgaaatgaaagtgcacctgctgcaacgagggccgtatattcgccaaggctatgtcctgctgcgtaatctgctttgattccactctcttcaaatttctttaagatggcgatacttgtcgttaaaagagctggctgcgcgttataagtgagcgtcagttcttccgcatctccttcaaaaatcattgaagataagtcaaaaccgagggtcttgtctgcttcttcaaatacagatttagatactgcttcttgatcaaataaatctttccccatgccaattttttgagagccttggccagggaataaaaatgcaattttagtcatgatgttttacctccattaagactcgttcgtggtttctttttggacttcttgatgaatgatggctgaaacgtctttttctacgatatcacgtgcctgacgaatggcatgaaaaatggcgttttcatcagaggaaccgtgcgctttaatgacaggtgcctttaaaccaaataaagcggcaccgccatattcggagtaatccattttagacttcatctgcatcaatttcggcttcatcatgccagccgctatttttgctgtgaagctggatgttaaggtttctttcagcattttaaatacagaaagagctgtgccttcaatcgttttgagagcgatatttcctgtgaagccatctgtgacaacgacatcagctacaccttctaataaatcacgagactctacatttcctacaaaattcaagtctgatgcttttaataattcaaaagtttttttcgtgagatcgtttccttttttatcttctgttcctacatttaacaatcctacacgcggattgctctttggaaaaacacgctctgcgtagattgaacccatcatggcatattgcacaaggtgttctggtttggcatcaacgtttgctccgacatctagtaataaaaacccgctgccatcaagtgttggcagtgttggagcaagtgccggtctatcgatgccatcaattcttcctacgataaacagtcctgctgtcatgagtgcgccagtgtttcctgctgaaatacaagcatctgctcgtccttcggatacttcttgcgccattttcaccatagatgaatcctttttacgtctgactgcacgtactggttcatctgtcggttcaatgacttcttttgcatctaaaatcgtaatgcgctcgttatttgttatgtatggtttgattttattttcatcgccgacaagtgtaatctcgatatctgaaaatgccgttaagcttttttgcacaccgtcaattatggctttaggggcatggtctccccccattgcatcgactgcaattctcatattacgtgccaccttttacttttgttttgagcgatacatgacgaagtcacctgagaagacaacttcctcaccaacatagctgtttacttcaactacagttctgcctttttctttatcatgcgaagctactttggcttttgagacgactcgttcgccttgtttaacctgccttgtaaatttaatattcgcttttgccgttaaagccagttcatcgtcaatgaccgctactgcaagcgaatttgcctgggcgaaaagatgatgtcccctggcaatttggtttcggctaaatacatgctcttttctcacttctaaaatggaaatggcttggtcatcaagctctacatcaatcatttctccaattacttcatccagcggaagtgacttcacttcatcctctaatgtcttttcagccacatgcttaattctttcgcgtaattcaggaatcgacagttccaaacgatcaagacgaaccgtttgaatacttacaccgaatttacttgccaattcttcatcagtaatgaacggagtcgagctgatcgtttgctggagaagcttttgacgttcttttttatttagtttcatatgcagacaccatccgtacatttatgactaggtactaatagtagtatataatctcatagatgataaatcaatccttgtttcaaaaagacaagaaaattcctccagcgcttgatcagcttaatttatctccgcccagcaccccgctgtctataagtgtttgccgaagttctttgtattcgggatctgtccaaaatgcatctgattgcacaagttctgccgcatcttttctagcagtttccagtgctctgtagtcatgaaccatatctgctactttaaattcaggcattccgctttgttttttaccgaagaaatcgccaggtcctcttagctctaagtccttttcagacagctcaaagccgtcggttgtttcggacataatcctcatccgctctttcccggtttctgattttggatccgccattaaaatacaaaatgattgatgctctccgcgtccaacccggcctctgagctgatgaagctgagacagtccgaagcggtctgcatcgtaaatgaccatgatggtcgcattcggcacgttgacgccaacttcaacgactgtggttgaaacgagaatttgtacttcatttgctgtaaagtctctcatcacttgatctttttcatcactcgccagtttcccgtgcattaagccgatcgcccacttaccgcggtatgcctctgtcagcatgctatggacatcaatcgcattttgcacatccagcttgtctgattcttctatgagtggacaaataatatatgcctgtcttccttttttcagctctttatccacaaatgcaagaattctctcaagcatgtcatgcttgacccaatatgtttcgatctgtttcctgccggctggtaattcatcaatgacggaaacgtccatttctccaaaaacagtgatggcaagtgtacgcggaataggtgtggcagtcatgaacaagacatctgggtcctgccctttacttcttaattttttccgttgttctacgccaaaccggtgctgctcatctgtaatcacaagaccgagctgctgaaattcgacttcgtcttggatgagtgcatgcgttccaactaatatatcgatctcgccctcttttagacgttccagcaattctctgcggcgctttccttttacagagcttgttagtagggcgatatttagtccccatttttcaaacagctgataaagggaatctgcatgctgctctgccaaaatctctgttgggaccattaatgcaccttgatagccggataaatgagcggcatatagtgcaatagctgcaacagcagttttccctgaacctacatctccttgaagcagacggttcatccggtacggggacgccatatcagacataatttcatcaagcactcttgattgtgcctttgtcagcggaaatggcaggctgtgaacaaactcaaaaacagcctctttggaaaacggatgctggatgcccgatgttttttctcgttctttctttctaatggcctgcatctttagctggaaaataagaaattcttcgtacacaaagcgtcgtcttgcttgcttgagtgattctcttgtttctggcaggtgaatggtttttaatgcttcctgataggacatgagtttataggtagagacaagctgctttgggagtggatcttcagctttatctacataaagtgacaaggcttgtttgacaaaacgcctcatcatcttcacggttacattttcttttactgaataaacaggctctatactgccatcttgctcgtgcgtcccttttttaaattcctgcaccatgatcgattgacggtttttatcccatttgccagtgacggataccgtatcacctaacacaaggcttcgttttaaataagggcgattgaagcaaatggctgtgatgagaaaacgcccgacaagcagcctgaatgtcagcctgcttcgtttttttccataataggtgaggacgggctcactgtgcacttttccttcaactgtgacacgttcgtcatgctttacttcttctaaattacgaagctcatagtcatcatatcgataaggaaagtagccaagtaaatcggctactgtgtggattccaagttcattgagtgttttttcagtttcttctccaatccccttgaggactgagacgttatcttgcagtttctgtatcacgagatgaggtcacacctccgaaaatcttcttttcaagctctcttgctgtcggtgttgcagcaagtccgccttgtgctgtttcgcgaagtgccgttggcatggtttgaccaattttatacatcgcatcaatgacttcatcacatggaatacggcttgtgataccagcaagtgccatatctgctgcgatcatcgcatttgatgcacccatggcgtttcgttttacgcacggtacctcgacaagtccagctactgggtcacaaacaagtccaagcatatttttcagtgtaatcgccattgcttcagcagattgctgaggggtaccgcctgccatttcgacaatggctgctgccgccatccctgaggctgaacctacctcagcctgacagccgcctgctgcaccagagatgctcgcattattggccacaacaaaaccaaatgcgccagaagtgaataggaatctgaccatttgttcctttgttggctttaatgtttgttttactgcaaataacgtacctggcacaacacctgctgagcctgctgtaggcgttgcacagatcgtacccattgcggcattgacttcatttgttgccactgccttactgacagcatctaatatcgtatgaccagacaatgttttgcctgatgcgatatacgcttgaagtttgaccgcatctccgcctgttaaaccggataatgatttcacacctttcagcccgttttctacggcctgctccatcacttctaggtttcggtacatttgggagaaaatatcttcacgtgacttccctgtcacttccatttcttgtgtaatcatgatttctgaaatggaggtattccgttcttctgttagctgcacgagttctttgacgtttttaaacatcatccataacctccttgttgttactctgcaatttgtgtgacttgaataatgtttggcagcgtttcaagctctgttaggacagctgggtcaatattttgatccacttcgatggtcatcagagcctcttgcccgacatctttacgcgccacttccatatgaccgatgttgatggcgaatttcgctaacacgttggcgactgccgcaatcgtaccgtagcgatcgttatgaaccacaagaatggcaggatgatttcctgaaagtctaagctcaaagccattcagttcagtgatttcaattttaccaccgccgatggaaatcccgattaattcaaggcttccgttcgcatctgatatctctacttttgctgtattcggatgcgctggtaccgcatcttcttctttaaattcaatgtcgatccctttgctttttgcaatatcgatcgctgttttgatgcgttcatcaaatgtatcaaaatcaagaacgccgccgataatggcgacatctgtaccatgtcctttatacgtatctttaaaagagccataaaatgaaacgacaattcgtttcggttctcttccaaataagctgcgagccactcttcctattcgagccgcacccgctgtgtgcgaacttgatggaccaatcatgacgggtccaataatatcaaacacacttctaaatttcataggtcttcccctctcataaccactcacatattggtttggttctttctttagactaatggattcaatcatttcccgcaactcatttcaccgttgaatcgttagtaaaaaattgcaaaagaagaagaagggcttgatttgcccttctttcgttattccacagccaaaatatatgaataaagcggctgttttccatcgtggacttcaacttctatatcttcaaatgtttcttcaataaaggcttctaagtcgtccatctcttcagatgatgcatcttctcctttaatgatcgtaacaatctcatcatcttctgtcaccattttggttaaaagttctttggctgcatctaattgatttttcgcagttaaggtgatttttccgttaaagagacccatataatctcctttggcaatgtcgattccatcgatttgggtatctctcaccgcaaaagtaatttgaccgctttttacgtggtcaatcgcttctagcatcgccgcttcgttatcttcgtttgaagctgcttcattgagagaaagaagtgccgacattccttgtggaacggttttcgtcggaataacaacaacctcacgacttgagacagttgccgcctgtttcgctgccatgacaatattagaattattaggtaagataaagacggtttcggcatgtacgctttcaattgctgtgacaatgtcttctgtgctcgggttcatcgtctgtccgccttcaatgacgacggaagcgccgatacttttaaacaagtcagcaattccttctcccattgcgacactgacgactccaaagcgctgtttttcagcagcaggtgcctttggtgcagcggtcgcatgttctttttcttcgttcacaatcgagctatgctgctctctcatgttttcaattttcatgttgatcaggctgccgtagcgctgtgcataggataagacatctccaggctgctctgcatgtatatgaactttcgccagcgtttcatcagataccacaagaagtgaatctccgaattcgcttaagtcttctctgaaagcattctcatcaaaggactgtttgtcttcttcaaatttcaccataaattcagtacaataaccaaattcgatatcttcagtgttcatatggctttgtgcacttttatgatgctctgcactgacaagctcttttaacgttggcaaagaggccgctttcgaaggaagctcctctcctcttaatgaagcaaggaaaccttcatatacgcagagaagtcctttacctccactatcgacaacgcctacttcttttaaaacaggaagtagatctggcgttcgctcaagtgatgctctcgcttcctcaatcgttaactcaagaacacggtcaatgttattttcggttgctgaaacagcaaccgctttctttgctgcatcctttgcaaccgttaagatggtcccttcaatcggcttcatcacggctttatatgctgtatcgacacctgcctgtaaggcaagagcaaattcttttgcatcaatcgtttctttttgttcgatctgtttactgaaacctctaaatagctgtgatagaatgacgcctgagttccctcttgcgcccatcaatagcccttttgacaatgccacgccgaccttcccaatatgatcggtatttgtttcttcaactgcttttgcccctgaagtcattgacaaattcatatttgtccccgtgtctccgtctggcactggaaaaacatttaacgcatccacaatttgtgcgttttgagaaagatggtgagcacctgcaagaatcatttttgcaaatgagcggccatcaagaattctaatagacaatatatttcctccttactacgggttcgtaactcttactccttgtacataaatgttgaccgaatcaacagaaagtccaactgtgtgagaaatcgtatatttgactttcgtttgaacattatgtgcgacttctgatatttttgtaccgtagctgacgatgatgtacatatcaatatgaatgcggtcttctttttgacgcacaagaacaccccggctgaagttctctttgcggagaatatccgtcaagccgtccttgatttgatttttggacgccatcccaacaataccatagcaatcgatcgcagcgcctcctgccaccattgcaatgacttcatttgatatatcaatttgtccgtattttgttctaagttcaatggacacattggttccccctttttgagaaattgccctgagttatcactattttactataagacccttctttttaaaagaaatcattcaatccgacccaatcctacttatactatagccttgattttttatcaagatgtcaaggtatttttcttgaaagaggagtaaacaatccttgcaaaccccttgaagctgtggtaaattattaaagtatcttgaggcatctctaagtacgtatatgaagaatatgatgatgttttcgcagttaggagggaaacaaatggcacgtaaatgcgttattacaggcagaaaaacaaaagctgggaacaatcgttctcacgcaatgaactctacaaaacgtacatggggcgcgaaccttcaaaaagttcgtattctagtggacggtaagcctaaaagagtatatgtatcagctcgagctttgaaatctggtaaagttgagcgtgtataagcaagagtaaacgcctgctacaataaattgtagcaggcgtttttatgtggaaataaaggagattactcattaatctttcttaaatgaaccaagcatcgcacggacaatgccgccaagaaatctaggcagtttgattgtataaaatttcattttgtccccctcctaaaagtaccgcttgcagcacaattgagcttaatcagccatccacattgataggttggtcaatctttgcttcttaccattattaatatgccttcacgaaaagaaaaagtaccatttgagtggatgagttcgttactaatacatagtgtggaaccaggctcaatatgacaatttttcagaggatatttgaaaccttttaatgtcagcttttcaaccggtgttccaaagggcagaaacgacacatattgtttatcctgatcttcttttatttcgtatgtaccaggttcaaacatttgaatgatattttgtttgtctacaagggtgatattctgcttgtgctgaatccctttgtaaagaagatggatatttcctagaaaatgatccgcccttcctcctgtaataccgtagatgtaaatatgtgctgggtgctgactgagtgcccagttcagtgcaagctctaaatcggtttcatccttttcagcttgaaagacattcagggcaggcaatttttctttcagctcccgaagctcttcttctgtcacactgtcaaaatcaccaaaggctttggcaggggtaatgccgtgctctagtaagaagagggttccacggtctacgccaatccagagaacatcctcttgtgatgcttcacgttcaagtggcgggatgtattcaaaaggaccgccggctacgatatgtatgtgcatgatatacgctcctctccatgtaaaaagaaccaaagatcacaatgactttggttccttcctttacgcttctcgaattgcctggatcgctgctgcgcggttgtctttaccgtataccgcagagcccgctacaagtaaattagcgcctgcctctttgcagctttttgcagtctctacattgacaccgccgtctatttctatcagtaaatcggttaagcccttttgttcactcagtgcttttacttcttttactttcgtgaggacagatggaataaatgcctgtcccccgaaaccagggttcactgtcatgaataacacaaggtccacatcttctaatacatgctcaatgtgagaaacgggtgtgtgcggattcaagacgacccctgcttttacaccttgttctttcatatgttgtattgttcgatgtaagtgcggacaagcttccacatgaacagaaataatatcagcgccagcttttgcgaatgcaggaatataccgatctggctgctcaatcattaggtgaacatcaagcggaagacgcgtatgcggtctgatcgcttcgacgacatttggcccaaatgtcatattcggaacaaaatgaccatccatgacatcaatatgaatgtaatctgcaccgccttgttccacatcacggatatctttctccaaattggcaaaatctgctgataaaatggaaggtgcaatataaaccatgatttagtacctcggctttctgtctttgatttctgttaaaaactctaaataatgctgatagcgatactctttgatttgatcatgctcgaccgcatcttttatcgcacacccaggctctttcacgtgcagacagccccgaaatttacaatctgcacttcggtctctaatatctaaaaagtatagacctagatcttctgcttcgatgtcagtaaattcgagcgagctaaagcccggagtatctgcaatgagcccgtctgctgttcgaatgagttcgacatgtcttgtcgtatgctttcctcgtccgagatgggatgagatatgatctgttttcagcgccaattcaggactcatcgcatttaaaagggacgatttgcctacaccagactgaccggcaaatacagtgattttatggtgaaagtgcggagtcagcttctcaatgccgtctccttcaatcgtagaggttaaatgaacctcatagccaatttgccgatagtcgtctgcatatgccatgatcgtttcacgctcttcgtctgttttcaataagtccattttagtgatacagataatcggctcaatatgattggcttcaacaagcactaaaaatctgtctaagagtgaggtgctaaaggttggttctgccgctgagaaaacaagtaccgcttgatcaacgttactgataggcggacgaacaagttcgtttgtccgttctttgacttctaataagtagccttctttatcgttgtctgcttgatacacgacgtaatcgccaacaagaggtgtaattttgttttttcgaaaaatgcctctcgctctgcactgaaccacttttccactctcttttgactcatccagtacatagtagaatccgcttaatgctttaataattttgccctcaggcataaagtccctcctttattcatcatcagggtattcgatcgttttcgagctgacgactttatcatcaaccgtcacttgataatatcctttttgacctggttcaatcttaaatttaatggtccgttcagtcggcgcagtgattttaaagctttcgtatgaatcagagatgctatgctccgcatcatcaatggaaatttggacattcatctcctgtccttccacttctggttcataagggatcgcaatcttttcggtcaccgttttggctggtttttccttcggtccaagagagaatgtaatcttgaccgtgtcacctggtttaacagccgttcctgctcctggttcctgcttcatgacctcgccttttggcacatcatcagaatacgcttctttttcatcaagcttcaagccgttatcctctaaataattcgatgccgcttgcttactatacgtcgttaaatcacgtaatgtaatatcggcaggacctatactgacagtcaacgtgacttcttcatctgctgctacaagttcagtattcgcggaaggactctgttccatgacaatcccagattcggtgtcattgtcattcacttcctccacaacgacctgtttaaacccttttttctctaagatttcttttgctttatcgaccttttcgcctgtcacatcaggtaattcggtcttttccttgccagtactttcgtaaagctgaatctctgttccttctttgacctttgtgccgattttcggatctgttttgacgacgagacctttttcaattttctcatcagcgatctctattgactccgaagcgacggtgaacccagctttctttaaggtatcttctgctttttcaaccgtcatgccagatacatctgtgacttccacatcttttggaaaaagcagccctggaaacacagtgatggctaaaattgtcgcagcagtcaatataaataagatggatgccacaatccatggccattttttccgtttctttttcggcttttgtttctcttttttcttcggtttttgagccggatggacggctgttttttcattgtcttgatcgatttgatgatcttgaataattgggatcgctttcgttgcttcatggtcttcttcaatgacaaagcgtttttcttttaatctggctggatcgaaagcggtttttaaatctttttgcatttcagatgcatcttcatatcgataaaatggatctttggccatcgcctttaaaatgatgttttccacgctttgtggaacagaaggattccaccttctcacagatggcggctctgattgcaaatgcttcagtgcaacactgacagccgattccccttcaaatggcatgcgtcctgagatgagttcatagagcacaatcccaagcgaatagatgtctgactttttcgttgcaagacccccgcgtgcttgttctggagacaagtagtgcacggagcctaggacagaatttgtatgggtaatggtcgctgagctgagtgccatggcaatcccaaaatccgtgactttgatgttccccatattgtctattaatatattgtgaggcttaatgtcacggtggacgagctgtttcgcatgggcttcttccatcgccgcaacgacttgttccatgatgcgaacggcttctttcggatgaagcggaccattggcgtgtatgtattccttcagcgtcattccctcgacatattccatgacaatataataaatgtcatcttcttccccgacatcgtagatgctgacaatattcgaatgatctaagcttgcagctgactgcgcttcccttcggaaacgtctaataaaatcatcatcgctcgcaaagtcaaaccgcaaaattttaatcgctacttcgcgatctaaaatcatatcttccgccaaatagacgtttgccattccgcctccgcctatgacgcgaagaatctgataacggccgctgatcctttttccgatcaacacttgctgtcaccctcctctggctgggaggagatttctaacagtactgctgtaatgttatcttcaccgccgttgtcattcgctgtttgtattaactctgttactttttcctctggtgcggttgtttgcgttaaaatatgaatcaaatgctcttcttctattttattcgatagaccatctgagcaaagcaggatttgatctcctgggtccacttcaaaggtgcgcgcatcaatttgaacacgcttatctgttcctaatgctttcgtgagcacattttttcttggatgatattctgcatccgcttttgaaatttcacctgttttcacaagctcattcacgagtgaatgatcatctgttaattgggtcagcgctccttctcttagcaggtagcagcggctgtctccaatatgcgcaattgtgaccgtttgcaaatgaacgagcgcacatacaatggtcgtccccattccttggcactcctcattgttttgcgcatgttcataaacttggtcattaatgtcactgatttttgagattaaccagctttcttgatcggctggcttttctggaattgaagatatttcttcccagtattcttttaaagaagagactgccatcttgctggcgacatcaccagcaagatgacctcccatgccgtctgctacaacagcgagaagtgaatcttcttttgcttcaaaaatacctgcatcatcttcattatgctgacggacttttcctgtatcggtaagaaaggctgcccttatcaacattcgtcacctcgtctcttcctgacgctccttcgctcttagctgaccgcaagcagcatcaatgtcatggccttgctctcgtctaatcgttacgtttacgccgcgttctttcagcgttttttcaaataggaagatttgttctctaggtgttctcacataatctctctctggtacatagttcaccggaataaggttcacgtggcacttgattccttttaataggtctgccagttcttctgcatggtgaacttgatcatttactccgccaaacaggccgtattcaaagctgacacgtctacccgtcttttgaatgtagtattcgatggcttccattaattttggcagcttatatgccttattgatcggcattaggcggcttctgatctctgtgttcggtgcgtgcaatgacacagcaaagttgatttgcatttgctcatcagcgaattgatagatctttggaatgattccgcttgtcgaaaccgtaatatggcgtgcaccaatatttaagccattatcatggttgatgattttaaggaaggcaagcatttcttcaaagttatcaaacggttcgccaattcccatgatgacaacagagctgactctctcgtctgtttcgtcaagtgcctgctgcacttttaatacttgtgcaacgatttctccggcttcaaggtttcgttttaaaccaccaagtgtagatgcacagaatgtacagccaattcgacagccaacctgtgttgtcacacagacagagtttccatattcgtgacgcataagcactgtttcaattgtataaccatcatgcagttcaaataaaaacttgatcgttccgtcctgagacgtttgtttgatcacggtttttaaagttgtgattgtaaattgatcttttaacttttctcttaattctttggagaggttagacatttcatcaaatgatgtcacacgtttctcataaagccactcaaaaatttgagctgcgcggaaaggtttttcatcttgttcttttaaccattctttcatttcgtgaagctcaaatgaatagatcgacggcatatctgttttcagttcttttcttactttttgttctgtcattttttatcccttctttctcatgctgcaaataaagaaaccatctgttccgaaataatgaggaagaatttgcacacttccgttttgaacaaacggagcaacctgctcaggcagccgttcattaagagatagatcgggttcgaagtcttggtgttcttgtaaaaacgcatgaatcacttgttgattttctgttgggtccattgtacatgtactatatacaagggttccgccaggctttaaaagcggagctgtttcttttaagattgcctgctgaattgcagcaagccttgctgagtcttctggagactttgtatatttcatatctggtttccgtctaatgacgccaaaaccagaacacggcgcatcaatcagaatccggtcaaatgaagcttcgctgtaatcaccctttgctttccttgcatcaagcgcttttgcttcaatctgagtaaggttcagacgttttgcggcttgtttaatgagtttcactttatgttcgtgcaaatcaagtgaaacaatttgtccttcgtcgttcatacgctctgcgatatgtgttgattttccgcctggagccgcacaggcgtcaagcacaatttctcccggctgagggtctagtgctcttgcgacaagcattgagctttcatcttgaatggtcacatagccttcttggaaagaaggggttgaaacgatggaccctttcatcagcttaagtgcatcttcagataagtcaccaagctccgtttcaatcccggcctccagcagctcttgctgcagtgcagcgcggtccgttttcattcgattgacacgaagggtttgctttggcggtactaaatgaatacggcacatgctttctgctgcttcaaatccgtatgactgaacccactcctgcacgagccataatgggtggcttgtctcaatcgaaagccgcttgaccggatctttgatgtcatcaaaagccggaacgccttctctttgcacagaacgaagaacgccgttcacaagtgatgaaatgcccttgtgccctctctttttcgttagctcaactgcttcatggatggctgcacgatctggaatcttttcaaggtagaccatttgataaagagacatccgcaaaagctgcatgacccaaggagccaccttttgcggttttttcacaaatggtgccagcatataatctaatgccagcttgttttgcagagtaccgtacacaagctctgttaagagcggtttgtcctgatctgccaagtctttgtctttcatgactgactgcaaaagcaaattactgtatgcttggttttgttcgagtttgattaaagcgtctagcgctacttctctcacattacttttcttcattcattaaccctaatttctgtccaatttcgatatttgcgcctcttaggaagtcttcgccgctcatctttttcttaccagctggctgtacacctgttaataaaaggccttggttattcccagttccaatgactggaccttctttttgaagctcaatcactttcccaggttcttcttgcgcttcgagtggcacttttttcgcatcccatacttttagatgagccccgttccattcagtataggcaactggccacggatttaagccgcgaacttggttgtaaagctcttctccggtctttgtccagtctaatctttcctgctctcgctttatattaggtgcatacgttgccgcttcttcattttgcggaattggtgaaatagatccgctcagaacattcggcacagtatctttcaatagtgcagcgcctgctacacttaatttgtcatgcaatgtaccgacattgtctaattcgtcgatttccacttctactttactgatcatgtcccctgcatcaagtcgttccaccatgtacatgattgtaacgcctgttttctttttaccttgaaggatcgcataatggatcggcgcgccccctcttagttctggcagcagcgaggcatgcacattgacacagccaaactgaggttcatccagtagtcgttttgggaggatttgtccaaaagccgctgtcacaattaaatctggttttaaggcaagcactttatcaatttcttcatcaaggcgtaccttttcaggctgcaagaccggaatgccgtgctttaaggcttccactttcacaggaggcggcgtgagtactcgttttctgcctttcgggcgatctggctgcgtgacgaccccgacaacttcgtatccttctgttatgagtgtttgcagcacaggtactgagaaatcaggggttcccataaatacaatacgtgccattttcttcacccttccatttccgcaagttctttttctgtataagtttgaataattttcgacgtaaataatatgccgtctaaatgatcaatttcgtgcaataaggctcttgctaaaaatccttctgcttctattgtaaatggtttgcctttcttatcaaaggcttttaccttcacatagctcggtctttctactgtgccgtataaagatggaaagctcaggcagccttcaatatcagtttgacttccttttacttcaagaacctcgggattcactaaatcaattctgccaggttcttctccgatatcgacaacagcaattctttgagaaatgccaatttgtggtgctgctagtccgactccatctagctcaagcattgtatcatacatatcatcaagcagttttttaagctttttatcgaacgtatcgacaggctctgccttttgttcaagtacgtctgccggatgtatgactattggttttactgccacttaaagccctccgttttacatcatcatatatggattcatatctattgaaatcatcaattgtttttgttccatttccttttgataatggtcttgtattttccgtagtaaacttgccagttcattttcccttttgtattttatcacgcattgatatcgatatctatctttgatcttagcgattggtgatgcagccggaccaaggatccttgtattcggtgcacagttcatttttaggaactgaacaatttgatccgtaacatgcgctgccttcgtcacttcctcatgtgatactgtcaccatcgccaaaaagtaatacggcggataggactggtggcggcgatgcagcatctcctgttcataaaaggcttcatagtcatgctgcttcgttaattcaatactataatgagaaggcgtatacgattgaatgatcacagagcctgctttttcatgtcgtcctgccctgccgctgacctgcgtgagaagctgaaatgttttttcacttgaacggaaatcagggatatgaagagacgtatcggcacttagaacaccaacaagtgtgacatcggggaaatccagcccttttgcaatcatctgtgtcccgagcaaaatatctgcttctttattgccaaaagatgtgaggagcttttcgtgagcacctttacgagacgttgtatcgacatccattcggatgactcttgcctctggcagtactttagtcagctcttcttctacacgctgcgtacccgtaccaaaatagcgaatatgctcactatggcattctggacattcagctggcaccggtgcctcgtgcccgcaataatgacatttcagccgtttttgatagcggtgataggtgagagaaatttcgcaatgaggacattgctcgacatatccgcaatcacggcacatcacaaaggatgaatagccccttttattcagaaataagacagcttgttcttttctttcaagcacttcctttaatctgatcattaattcttctgaaaacatggacctgttgccatttctcaattcttctctcatatcaattaacgaaacgtgcggcagctgctgctggttgactcggtttttgagcgtcagcaatgtaaacacgccttttttggcacgcgcgtaggtttcaagtgaaggggtagcactgcctaaaacgactgggcatcgatgccttctggctcgttcaatagcgacgtccttggcatgataacgaggcatttcctcttgtttataagaagattcatgctcttcatctatgataatcatgcctagattttcaaatggtgcgaaaacagccgatctcgcacccacgacaagcttgacttccttgcggtgaattttccgccattcatcatatttttcccctgtcgataagccgctgtgaagtacagccacatttgaaccgaaccgttctttaaaccgctgaaccatttgaggggttaacgagatttctggaacgaggacgatcgcttcttttcctttttgcagggcatgatcaatcgtctgcaagtatatttccgttttaccgcttcctgttaccccgtgcagcagaaaagtttcatgccggtcatcactgactgcttgatgaatatgttttgccgcttctctttgttctggcatgaggtcaagtgaagcagaaggtgtaaacgcccggtcacgataaggatcccggtagacctcttcatagctttctgttagcagcccttcttgaataaaggttttaagcgtttgagaactcgcgcttgtttgctgctgcaagtctttcgctaaaaaggttgtctcactcgcttgaagcaaaaaggagagcaatgccttttgtttcaccgcatttttcttcagctgctgctgtttttcttcaagcttatctttggatacagctagttggagcgtgcgcacttttttctttccagatttttgcgagacgtgataccttacctctaaataacctttttggacatgcttttgaatctgttttagttgttcggctgggatgtcagcataaagaatgctatctcgctgaccgaaaagctctttcaatgactgcggaagttcttcatctgacagcacttgaatttctttttcatatttcgccttcatggctgcagggagcatcgattgaagtgccgtaatgtgataggacaacgttttttccgtcagccagtgggaaagctccaatagctcatctgtcagaacaggtgacaagtcaaataaatcgacaatgtcctttatgcttcctgtttttacgtctgtttcttctttgacttttgtcacaaacccttgaatcttcctcgggccaaagggaacgaccaccctcattcccgctttgacgagatctttgaagcgatctggtacacggtaatcgaatggccggtcaatggctttcgttgtgacatctacgatgacttcagcaatcattctcgatcacactcttttggcaacagctgttttgcctcctttaagatttcaaaagcgaggtcttttttgctcatcatcggcaattctgttgttgtaccatctgctttgatgatggctgctacatttgtgtctgtgccaaagcctgcaccttcttttgtgacattgtttgccacaatcatatctaaatgcttggattcgattttctttttcgcataatattctacatcctgcgtttcagctgcaaaaccgacaagcacttgatgctcttttcttttccccagctcttttaaaatatcttttgtccgggtgaattcaatctctaaggcgccgtcctgttttttcattttatgagtatatgaggtcacaggggtatagtcggcgactgctgctgatttaatgacaaggtccgcttcctcgtacacagctaatgcggcttgatacatgtcctctgccgattcaacgtgcaccacatgtacatgatcaggtgcatttaaagaaacaggtcctgaaataagcgtgacatctgcccccatctgctgcgcagcctctgcaatcgcatagcccatttttcctgaggatcgatttgtaaagaaacgcacaggatcaatgacttctcgtgtaggacctgctgtcaccacaacttttttgcctaaaagcggtaagctttttggctcttcaaaaaatgcacggatgtgctcaacaattttttcaggctcctctaatcgtccttttccaatgtagccacaggctaaataaccttcactcggctcaataaaccggtagccgtcctcatataatgtgcggatgttccgctttacagccgggtgatcatacatatgcacattcatagctggtgcgatccatacaggagccgttgaagcaagtaaggtcgtcgtgagcatatcatctgcaagcccagcggccattttaccaatcgtatgtgctgttgcaggggcaactagaatgagatcggcccagtcagctacatcaatatgcgctatgacttttggattattttctttaaatgtatccacatacacctcatgtcgagacagagcttggaaggtaagcggagacacaaactcacgagcagattctgtcataatgactcttacatttgcgcctgcctgtacgagtttactagtaagtgcagctgctttatatacggcgattcctccgctgacgccgagcaaaatattttttgactgtaacattagtttgtcccccttaacggccttttcacaaattcgtctacaattcaaaaaagtcaaaaccaatcatagttttgacttttttgaacgtatcgtatctgcatagcagaagcgatgtgttattcttgatcctctttttcaaatgtcaaaagaccggcatcaatttcttcaagtgctttgcctacaaatttgtaagacttcgtattttcgatttgctgatcttgatggatctgcatttcacgtgcacggcgtgcagacactgtcacaagtgtgtattttgaatcaagtttattcatcaatgagtcaattgaaggatctaacataatttattctacccccagcatttttttatatcttggtgcgactctgtctctgcgcaggtgttctgcaaggacgatcgctttgattctttcacaagcaagctcgacatcatcgttttccacgacatagtcgtaagcatccatcatttcaatctcttcttttgcagcagccattcgatttcgaatgagctcctcagactctgtaccacgcgtaatgatgcggttctgaagttctgaaagactaggcggtgcaaggaaaataaaaagaccttctgggaatgcttctcttacttgaagtgcaccttgcacttcgatttcaaggaaaacatcttttccttcgcttaatgtctgttctacatagtcaacaggcgtgccgtagtaattcccgacatactctgcccattctaacagctttttattttcaatcatatgttcaaattcttccctggatttaaagaaataatcgacaccatttttttcaccttcacgcggtttgcgtgttgtcacagaaatagagtattcaaatttcgtatcttcctgggagaaaatggcttgtctgaccgttccttttccaactcccgaaggtccagagagaacgattaaaagtcctctttctttcataatggcgtattacccctgcccttcatctatgatttcttcttttacagaaagtctttgcgcgacagtctcaggctgaacggcagataagatgacatggtcactgtccataatgacaacagcacgggttcttcttccgtatgtagcatctatgagcatgcctcgatctcttgcgtcttgtatcattcgtttaatcggtgctgattccggactgacgatcgaaatcatccgattcgctgaaatgatgtttccaaatccgatattgatcaactttatggtcatcttctaacgtccccctgtattataaacgtctctagtctcgccgaaagagacgtactgtaaacagcatacacaatgactattctatattttgcacttgttcttttattttttcaatagcacttttcatttcaaccaccagcttagttaaatgatgatggttcgcttttgagccaatggtgttcacttcacggttgagctcctgtacaagaaaatcaagttttctgccagcagcaccgccttgcattaagatttgctggaattgctgaaagtgacttttcaatcttgtaatctcttctgtaatgtcacagcggtcagcaaagatcgcagcctctgttgtcaatctgctttcgtcaagcgcctctccgatccagtcttgcaatcgctgattgagcctgtctttatactgactcacaacctctggtgcaaagactttgatttcttctgtgtaggcctctaattcagaaagcctcagctcacagtctttttgaagtgatgttccctcctgctctctcatgaagcaaagctctttgacagccgtttcacaagcttccatcagcaattgctctaattgctcatttcggctggacgattcttctacttgaacggcatgctccagccccagtaagtcatgtgcatgctgaatgcctgaaatgtgatagcgtttctcgagatcttttgcggctttcatgtattcatcgagcagcggccagtcaatctgcaaggaccggcttgctagtttaccgccttcaatcgtaacaaacagctcaattctaccgcgctgcacgtgacgaagaatgattttttttaatgtgtcttcgaaatataaaagcggcctcggcaaacgggcatgaacctctttaaaacggtgattgaccgattttagctcaactgacactgtcagttctccatccgttttactcgcttggccgaatcccgtcatactgcgtatcatgtcaaaacacccaattctttcatattaataaaatgaaaaaggtaatagcagacactattacctcaaaattataccataacgaattatttttttcttgtcaaaagtgatcctgccagtaaaaaagttggcagtgcagacataccgatgatcagtagccaatcaattgctgcaatcgccaccgttttgaaaattggctgaagcggcggataataaatgaccacaaacatcaataaaagtgatgacaaaaccgcgccgatcaagtagagattaccgaatggattgcgctcaaagatggatcgttcactgcggcagtcaaatacatgaatgagctgcgccaacacaagtgtactaaatgcaacagtctgcgcatatggcaggttgttcggatcacggtgatacacaaacataaatgctaaaagggtcgcaagtccaatgaggaaccccctagatacaaccttccatccgagtcctctagcaaaaatcccctctttcatattcctcggctttcttttcatgacatcgccttctggcttatccatgccaagcgccatcgccgggagaccatctgtgacaaggttgacccataaaatttgaataggaacgagtggaagcggaagcgctagaagcatcgcaaacagcataaccaaaatttcccccacatttgatgccagcaaataacggacaaatttacgaatgttttcataaatattccggccttctttaatggccgatttaatggttgcaaagttgtcatcaagtaaaataagagaggaagcttccttggcgacatctgttccagtgatacccatagagataccgatatctgcttgcttaattgcaggcgcatcattaaccccgtcacctgtcatcgctacaatatgtccatttttttgataggccttcacaattctcagcttatgttccggtgatacccgtgcaaaaacgtatacattttcagccgtttgctcaagctctttgtcactcatgtgatctagcgcttttccgtcgagcacctttccttgctttggtaaaagactcaagtctttcgcaatcgctttggctgtttccacgtgatcccctgtaatcatgactgtttttatgcccgcatccctgcactctttaatcgctcgcctcacttcaggacgaggcggatcgatcatgccctccaacccaataaatgttaaatcagtttcagcctgctggacagtgttgattgtttcagtcagcccaacttttttatacgcaatggcaatcgttctcagcgcctgccttgctaaaccttgaatcgcagcctctgtttcttgcctgtgagtggttgaaaatgaagctgtgcggccgccgtgcatgatatggcttgaacggttcatcaggacatccggcgcaccttttgcaatgacgtaccgctctttttgattcgtttcgacgacgactgacatcatctttctttctgaatcaaaaggaaactcttctaccacgtgaaatcctgcttcgatgaattgctctgtaaaacccgctttacgtgctgcggtgagaagtgccccctctgtcggatcaccatcaagcctcatttcgccatctttttcaacgatggtcgatgtattacaaagcgccccgtataataacaccttttgcaagcttggatgtttgtctacatggacaagttctccgttcaaggtgaaatcaccagatggctcatagcccgtaccagaaatattccacgttttgccctctgcccatacatgggtcacagtcattttattttgcgtcatcgttcctgttttatctgaacaaatgatcgacgcgcagccaagtgtctccaccgccgggagctttctgacaatcgatttttgtttgatcatccgctgcactcctaaggaaagtgcgacggtgacaatcgccggcaggccttcaggaatggcagcaaccgcaagtgatactcccgcgaggaacatatgatacaaatcatgtccttgcacaacaccaagaaccacaacgagcaccgttaaaaataaagcagccacaatgaggattttccccagctgttcgagacgtctttgcagcggtgtttccatattccctgctgcatccagcatgccagcaatttgtcccatcgctgtattcattcctgtcccaatgacaacgcccacgccgcttcctctagtgacaagcgtccccataaaggccatgttcgtcaaatctccaagcgagacatgattgctagaaagaggacttgcgtgtttgactgctgggatggattcgccagtgagagcagactcctcgatttccaggctctttgtttctagtaatctaatatctgccccaatccggtctccgcttgaaaatttcacaatatcccctggcacgagatgtttagacgggatcttgatccattcattatttctccttgcatacacgtgcggggttgataattcctttaacgcttgaagggatttttccgcccgtcgttcttgataaaagccaagcactccattaatgagaacaatcgctacaatggctactgcatcaatgtattcgcccaggaaagcagaaatgatcgttgctgcaagcaagattaataccataaagtctttaaattgcgctaaaaaaataatcagagccgatgcctttttcccttcctgcaattcgtttggcccgtgtttttcaagccgtttttgtacatctttttctgacagtccgtcacctatcgatgtattcattgtttttaataaatcggtttggttcagttcatgccaattcatttgacctcgtccactcctcttttgttctctctcatatgcagtgttctataagccagtttattcagactcgtcctaaatcatgctataataataagactgcctaaagaacgagaaatggaaggttctttcagtagatttgtgtgaaagaagagggtgtatccaacatgtcatttgacggcatttttacatatggtatgacaaatgaattgcaagagacattaactggcggtagaatttcaaaaattcatcagccatataaacacgagttgatttttcatatccgggcaaacggaaagaatcataagcttcttttatccgctcacccgagctacgctagagtgcagctcacagagcagcaatatgacaatccaagcgaaccaccaatgttttgtatgctccttagaaagcatcttgagggcggatttattgagcgctttgaacaaattggatttgaccgggtgatcgtacttcatgtacgaagccgcaatgaaattggcgacgaacagactcgaaagctctacattgaaattatgggaaggcatagtaatttgattcttgtcgaagatgacacgcagcagatcatcgatggcctgaagcatctttctccatctgtaaatagctatcgaacagtgcttcctggtcacgaatatcttttgccacctgcgcagcaaaaattaaatccgtttgcagtaacgaaggacgatattttaaagcatttacgctttcaagaaggaatgatcgcaaagcaaattgtcgatacattctctggggtttctccgctgtttgcaaaggaagctgtacacagggctggtctagccaatcaggaaacaattccaaatacactgctcgacatgttccagcttattcgcatgcattcctttaccccgcagctcacaagaaaagacggaaaagaatatttctatttattagaactgcatcatgtcgatggtgaaatgaaaacattcgaatctctcagcaagctgcttgaccgcttttatttcggcaaagctgaaagagacagagtgaaacaacaagcgtctgaccttgaacggtttgtcgtaaatgaaaaaaagaaaaatgaaaacaaactcaaaaaactgaacagaacccttgaagaatctcaaaatgctcataaataccagctctatggtgaattgctaacagccaatttatatgccatcaaaaaaggggataaagaagcaactgtcatcaattattacgatgaagatggcggagaggttacgataccgctgaaaacaaacaaaaccccctctgaaaatgctcaggcatatttcacaaaatatcaaaaggcaaaaaatgcaatagaagcggtcaatgaacaaattgaacggacacatgaagagatcacttattttgatgagttgattcagcagctgtcctctgcctcaccgaaggatttagaggaaatgagagaagagcttgttgaggggaaatatttacgcgccaaacaaaagcgcaacgccaaaaagaaaaaaacgtcggccattcagcttgaaacgtatgaatcgtctcaaggtattccgattttagtcggaaaaaacaacaaacaaaacgagtatttaaccacaaaggcagccgcccgtgacgacatttggctgcacacgaaagatattcctggatcacatgtcgtcatccgtcatcaaacgcctgatgaacagacgctgcttgaagcggctcaaatcgctgcctacttctcgaaagcaaaagagtcgagctccgttcctgtcgattacacgaaaatccggcatgtgaaaaaaccaaatggagccaagcccggatttgtgacgtatgatcaacagcaaacattatttgtcacgcctgacgaagatgtcgttctaaagctgcgaaaataataaaagccgataaaatcttttaaagagattttatcggctttttctttgttgtttttttctttcgatatagagagcatcaagtgcatctacatcttcttgttcaagcaatgtctcaatttccgcagccagttgttttgtccgggctgggctcgcaccgcttgtagagactgaaatcgtcacttttcctgctttgaccacctttggcacgatcacattgccaagctctgattggctcacacaattcacaagctgatgaggtcgtgctgtttgggcaatccattcatttaccgctggatcgtttgtagcagcgacaatgaaaaatgcatcctctacatcttcagcctccactttcttttctttccaatgcaggttgtatgtatcaatgagacgtgccatctctttagaaatgtcaggactcacgatggtgatatggcaaggctctatgcatagcgcctctgcccttcttgcagctatttttccaccgccggcgatgagcacttgttgattggttaaatcaagatggactggaagcatggcttactccttggaaatgaaacacatcatctttgtttaaaatggtttctttaacgcgttcaatataagctgcttttacatgcggatgaaagccaatataccggcatacccggacatctttcagcctctctctcgcctgagcggcttcattttcaatctctttcattaaaatacccgtaaacaacaagtagggaacgagataaacaggtgtatcatcatttgctgttaatttcgcaagaacatctcggtaatttggctcacatgccgtaataaaacatggtaagacctctgcgagaggaagcagccgccggacatcgtccgcaatgccaaacacatctcgcttcacatctggatcagagcttccacggccaattaaaagaatccgtgctttcccgccttgatatcctgcttcttcaattcttgcagcaactgcttttgtcacttcttgattgaccccaattggtttcccgtaggtgaccttcacttgcgggtatcgtttttgtactttctcaatctcaactggaatatccgacttagcatgcattgcagttaaaaggaggagcgggacgatcgcaatgtgtgtagctccttttttcacacaggcttcaaaaccttcctctatagaaggggctgtcagttctaaaaaacaaatttcttgtatttcggcttctactaacggcatacagcttttcataaaagaaatggctttatcttgtgcttctttcaccctgcttccatgcccaacataaagtacagcttgtttcatgtgactcctccttcttacttgttttgttcagacgaaaagacacgatcaatgcacgtgtcttttctctaacattctcaattctcaatgagagccggttcaaaccagttcagcttttggtgaaaatgaacgacatctccaacaactattaagcttggatgctcgataccttctttttcaacggtttcagacagtgtcgccacagtgcagcaagtcgtcttttgccttgtcgtggttccccagtgtataaacgctgctggcgtttcaggatcgcgtccattttttatcagaagctgctgcactctttctacgtttttgacgcccatgtaaatcacaagggtatcaatccccgtagctagtgcctcccacttttcttcaaaatgctcatccttttgataatgacctgtgacaaacgcaacattcgagctgaattcacggtgcgtcacgggaatgcctgcataagcagctgctgcaataccagaggtaattcccgggacaacttcatatgaaattccgtgctcagctaagcattcgatttcttcaccgccgcgtccaaatacaaaggggtcgccgcctttcagccggacgaccacattcccttcctttgcatgggtgacaagagcttcattgatggcttcctgtctcatcgtatgatgattcgggagcttgccgcaataaattaattccgcctcgggtttggcgtgggcgagtatttcttgattgacaagacgatcatataaaatgacatctgcctgctgtattgccttatgggcttttaatgtgattaagtctggatctccaggcccagcccccacaatgtatactttccccatcgtgcttttctccccctgccatcaggcgattatttcgcttttccttttacataatcaacaagacgctgtttggactcttcacgcgataattcacctgtatctagaacaagctcaggtgctgccggctcttcatatggcgaatcaattccggtaaaaaatggaatttctccatttctagcttttttatataacccctttgggtcacgctcttcgcatacattcagatcacatttcacaaacacttcgtgaaactctcccgcttcaactaactgtctgacaatgcggcggtcttcttgaaatggtgaaataaaagccgtgatgacaatcgttccttgctcaacaaataatttcgccacttctccaatgcggcggatgttctcttttctgtcatcatctgaaaaccctaaatctttattcagaccatgccgcacattatcgccatcaagaacagtgacttgataaccttgttcaaacagctctctagccgctgcatttgcgattgttgatttacctgatccacttagacctgtgagccaaataatgccgcttttatgattgtttttctgttgatattctttttttgtaatagatgaatcatgccacacgatatgttcgttgctcatgtcataccctcccattaagataccgtcgtttttaatccttcgattaatgtttcaatgacctcttttcggctgaacgtgctaggcggtaattctccgtttctgagcatcgttcgaacctttgtacctgaaagaatgacatgctcgcttttatcgtgaggacatgtttttggcgttgccattgcttcacatgtattacagtagaagctatgttcaaattttaacggggtaataccaatttcttcgcttgtaaattgttcaaataactcctgcgcctcatatgtgccgtaataatcaccaacacctgcatgatctcttccgacaataaagtgagtacagccgtaatttttacggacaagcgcgtgaaagattgcttcctttggtccagcataacgcattgccgcaggaaaaacacctaaaaagacgcgatccttagggtaataaccgttcaataacacttgatagcttttcattctcacgtctgccggaatatcgtctgattttgtttcaccgacaagtggatttaaaaataatccatcgacggtttcaagtgctgtcttttgaatatattcatgggcacggtgaacagggtttctcgtttggaaaccaacaatcgttttccagccgttctctttaaaatgacgtcttgtttcttccggctcatacgtaaattgagggaatggtttttcgctgcgtttcgtcagtgtgattttaccaccaatgtatgtgtcaccgcgttcaaataattttttcacacctggatgattgcggtcatcagttttatacacattcaccgcttctttttccttatctggtgtgtattgatcctctacttcaatcacgccatatacagttccattatacgatagacgcacaatatcgccttgatggatttcccctgccttttcctttgtcactggcaatgtaataggaagagaccaaacgacaccacttgctagccgcatactgctcacaacagattcataatcagcttttgttaaaaacccttcaattggactatacccaccaattgctatgagttcaaggtctgcaaaagagatagcatctagttcaatttcctttgcagccgtgctgagatcatattcttcatttactcgattaattaatacgccaccatgtggtgttaaactcatttgtatcttcctctcaatgttcatatttagtagatgttaatagtcggatttaacattaaatcccgccgccctgttcatgaatcgagctgctttcatttttgactgccttcatcaaacttagcgcaccaagtgaggcaagcagtacactcatcatgataaaaatagagtaatagtcaccttttaagaaaaggctcactagcaaatacgatagactaagtgataaaaagggtgatactacccacactttcagcatttttttcaccacatgtttatgaaaaatattaggtccaccttttgccatgccaagtccaatgatagacgaggaggtgatttgggtaagtggaactggcagcccaaaaatagagctgacgatgacaagtccagcaccggtaccggaaagcaatatcccttcgcccgtttgatagcgggtgattttctttccgtttgtttccagcacccttcttcctaataaaagagcacccagtgcaacgaaaagtccgccgtaaagcgttccttgcccaacggataaaatgcctgaagcaacaagggggcctacagcatttgcgacattgttcatcccagcagaaaatgcttctagaaatccactgatgatcaaaataatcgataaaatcaaagtgcctttttttgaaaaggttcgtttcgggaacattctgatgattttgactacaatgaatgtaaaaagaaaagcaacaataggaatgatgacccaaaaggacacgatgactaaaatggatttcacatacaatactttatacgcgaccgccactccaacgacagcacctactgtcacctcactcgttgataaagggatagccatcaaattcgctataaagagcgataaagcagcagaaccaataataatacatacaatttcaagtgtaatgacagattcaggcataatgccagagctgatggttttgacgacctcaccgccgccaatgactgaacctgctaaaatcccaactgcacatacactgagtgcatagatcggctttcgaatcgcacctgatccgtatgcgatgcccattgaagcagctgcaccactcgcgccaatgtttagcgcgaaaaataaactaaataaaattgcggcaatttccatacattatgctcccttactcatgtaatccgcactcagtcttagctgtgcctgaccatctgccagaccgcagatcctcggcagtaaatgctggctgtgtacacggcgcacagccgatacttggatatccttgatcatgcagcggattataagtaagttcctctctagatgcatatctccatatgtccttccacgtccagtggataagcggacatactttcactgatttgaatttttcatccttatttaaaaagttcgtccctgctcgcttaggtgactgctctcttcttaagccagaaagccatgccggatagccagataacgcttcttgcaaaggaatgaccttacgcatatggcagcagctttgagggtccgttttccatagttgatcaccatgctgctcgttttgctcctcaaccgtcagctcaggggttttcagcacaatatctaaacctgggtatctttcctttaccgcatcaattgtgtcgtacgtttccttaaaatgcagacctgtatctaaaaagacaattcttgcatccttttttaccttcgcaatcaaatcaatgaggacgatgccttcaataccaaaactacatgcataaacgagctgatcaccataatgaccgtatgcccatttcagcacagataaggcccctttatacaaatcgtcttcttgaaatgtaatggacggctcttgccaattttcataagttaacattgtttctccccttccggagtatcactactctccgcactacgtcaactgaattttttctgtcttcttccacttgaatcacttgaccgtcctgaacaatcagtgtaactaaactgaatcatatccccaatcagtttctgcataggcttcaattaagtcttcatcctgcttttgctctcacttcctcctcatcgttaaaataaaaaaactccctttcagtccgaaagaaagatgaggaagcttacgatttccttatctttcaaaatagaatcattttgcaggatgtagcaccttgcaaatcgcaggttgccgggcttcatcgggccagtccctccacctctctggataagtgttttaatttgtcttaaatattaacacaattcaaacaaaagtcaacccgactttattgataggattagtttttatttaaatttgagtctattttactattttcaccaaataaaaaagctgtgcgggttcgcgcagcttcagattatattcagcatgatagaaaaccattgcagtctaggaaagacgagtaccagagcggagcgaattgaacattcgtgagcactggcacgcagtcctgacaaagaatgcgagagtttgtctacacgctgaaagctgtgcggggaggcgcagctttttagacggtttcttccatccaagattcagaggaaggatcttgtctccagcgtttcagtttattcatagcagaaggctcaatcgctttcagctcaagtgccacgtctgtcagggtgtcatagtctgttagtgtgacatatggaatgtttttctcttggaatgctgccgcagcttttggcagaccgtatgtgaagattgcagcaacgcctagtacgtcacagcccgcttcttgaagagcagcgaccacttcaagcacactgcctcctgttgaaatcagatcttctacgacaaccaccttttgaccttttgatacggcaccttcaatttgattcccttttccatgtgcttttggtttacttctgacataacacatcgggacgttcagacggtctgccgctaatgccgcatgcgggatgcctgctgttgcagtaccagcaatcacctctgctccctcaaaatgagtgagaatcaactctttaagaccttcagcaatgtcgtgtctgacttctggataggacaaggtgagacgattgtcacaatagatcggtgatttgataccgcttgcccatgtaaacggttcgtctggtttcaatgagaccgctttgatttgtaataggtgtttagcgatttttgttttcatctggcagtcactcccactctttcaaaatttgatgataggcttccaatggtttttcagcttttgtgattgaccttccgacaacaatttgtgaaacaccttgctcttttgcataagcaggggttgccacacgcttttgatcatcggtttgatcatttagtaaacgaatccctggcgtaacagtgaggaaatcaggtgagatgtgctcatgaagggctttggattcatgaacagagcaaacaacaccgtctagtccactttcatatgccaattgaccgtaccgaataacagtctcttgcagcggacggtctatgagtaattcgcttctcatcatgtcttcagatgtactcgtcagctgagtcacagcaataatgcccggacgtttttgtccagcaggcgttccgctttcaagcccttctaacgcagcttgcatcatctgtttcccgccagcagcatgtacattaactagatcaacgccaagtgcggcaagccggttcattgcttttttcaccgttgttggaatgtcatgtaatttgagatcgaggaaaatgcggcaatttttttctttaagcgcctcaaggatgacaggtccttcttggtaaaacagctccatgccgaccttcacaaataacggtgtcccttcaaagggttctaaaaaggcgagcgcctcctgccctgatggaaaatcaagcgcgatgatgggcaagtgcttcatgtttccagctccttccgatacattcctctacagatgaatacccataggctgataatacttttggcagttcttcaatgatttctgggcaaataaatgggttcacaaaattggctgtgccaacagctactgcactcgctcctgctagtaaaaattcaagtacgtcttcagcattttgcaccccgcccattccgataatcgggatagacactgcttgactgacctcatgtaccatgcgcacagcaacaggtttgaccgcagggcctgataatccgcctgttttattggcaagaatcggtttccccgtttttaaatctaaacgcataccgattaacgtgttaatcatcgtgagtccatccgctccagcagattcaatcgcttgagcaatctccacaatattggctacgttaggagacagtttgacatagacaggaacggaggacacgtccttcaccgcttttgtcaatgctgctgccatttgaggatctgtaccaaaggcaattccgcctgttttgacatttggacacgagatattcagttcaagggcatggacattttttgcttggctgatctgcttcgctacttcaacataatcatcgacctgtgagccagcgacgtttgcaataataggcgtatcaaactgctcaagccaaggtaattcattttcaagcacgcctttcagtccaggattttgaagaccgatggcattgagcatcccggcacctgtctccgctacccttggtgtcgggttgccaaatctcggttctaaggttgtggctttgatcatgataccgccaagcacggataagtcgtataatgaagcaaattctcttccgaatccaaagcagcctgacgccggaataattggattctttaatgataagccgggtaactcaacgtttagcatgacaatgccacctcctctgctttaaatacaggtccgtccagacagactttgacgtaagctttttcgtgctggtctgtatgacaaacacatgcaaagcaagcaccaatgccgcagcccattcgctcttccattgaaatgtagacaggcttatcggggtaagagtcttttagtgcctttaacatgggggtcggcccgcaagaaagcatgacatcaaaactcaaatcattctcttcaataacacttgtcacgaagccctttgcgccatatgtcccatcaactgttgcaataaatgtatctccgagtgcttggaatttctcctcgtaaaatatatcctttttcgattgaaagccaaggacatgcttgacgatgacgccttttttcgttaaacgcttggacagctcatataaaggcggtactccaatcccgccgccgactagtaacgctgtctgacctggctgaacaactgaaggatcatatccgttgccaagcggccctaatacatcgatggattccccatcccgcttttgggaaaggagctttgtgccctctccctctgcgcgatagatgatggttgcttcttgtttctcggcatgaatattggcaatactgatcggtcttctcagcagcggtgtcatggactcgctgaccttgatatgaagaaattgtccagccgtttgaaaggagtccacaaggtcaccttttaatgtcatttcgtaaatatgatcagcgatctctcgatttgagacgaccgtcaagtatgcttttttcatatcgttactgtcacctcagcattcgttttcacttctggcatttcgtccgctctaaatgtcatgctttctagtactcttaaaatcgcttctgctgtatctaatgacgttaagcaagctacgccattttcaacagcttcacgtctgattctaaagccgtctcttgccggctgttttccttttgtcagagtgttgatgacaaattgggcttccccgtttcgaatgacatcgagaagatttttgccttcttctcctattttgccgacaacacttgatgggatggaggcttgttttaagtaattcgccgttccttctgtcgctaatatatggtagccgattgaatggaatcttctcgcaatctcaagtccttcttctttgtccttatcagcaactgtcagaagaactgtcccgtctttaggaatttgaatgcctgatgcaattaatcctttgtaaagagctttttcgattgtgacatctttccccatgacttcacctgttgatttcatttcaggtccgagtgtaatatcgactcttcttagtttcgcaaaagagaagactggaactttgacgtacacgccttcttgctctgtgtgaagtccttcttcgtagccatagtttttcagtttttctcctaaaatgacctttgtcgccaggtttgccatcgggatgcctgtgattttacttaagaaaggaactgtccggcttgaacgcgggttcacttcaagtacgaacacttcaccttttgagagaacaaattgaatgtttagcagcccaataatgttgagtccttttgcaagcttgatcgtgtaatctgcgatcttcgctttgatctcttcagacaatgtttgcggcgggtaaaccgcaatcgagtcaccagagtgaaccccagctctttcaatgtgttccataatgcctgggatcacgacggtttcgccatcagacacagcatctacttcgatttcttttcctgtcaaatacttgtcaatgagcactgggtgctgcggattgactttcactgcattctccatgtagtgaagaagctcagcttcttgataaacgatttccattgcgcgaccgcctaatacataggaagggcggacaaggactgggtagccgatctgattggcaatcgctacagcttctggcacagatgtagctgttttccctttaggctgcggaacgccaagtgcttctaatgtttgttcaaacttgtctcggttttccgcgcggtcaagatcttcaagggaagttccaagaatcttaacccctctatttgataattcgtcggctaagttaattgctgtttgtccgccaaactgaacgacaacaccttctggtttttcaaggtcgatgatgtgcatcacatcttctacagtgagtggttcaaagtagagcttgtctgaaatactaaagtctgttgagaccgtttcagggttgttgttaataataattgcttcataccctgcttgtttaattgcccacacagaatgaacggtcgcataatcaaattctactccttgaccgattctgataggacctgagcctaatacgatgacgcttttcttgtctgtacgttctgattcattttcatcttcatatgtgctgtagaaatatggcgtctctgattcaaattcagctgcacaagtatctaccattttgtaaacaggtacgatgcctgcttcttgtcttagcgtgtagacatccgcttctttcatattccactcgcggctaatatagatgtctgagaagcctttttctttcgcttcttttaatacgtctgtattgcctttgttttcttttaatgtcttttcaaaagcgatgatgccttccagcttatgaaggaagaagtaatcaatttttgagaattcatgtatctgttcaaccgtatagcctcttctaagcgcctcggcgatatagaataatcgttcgtctcccgccttgataatccgcttttcaagcacttcgtttgtgatatctgcttcatcttttaattcaatgtgatgcacatcagcttcaagtgaacggacagcctttagaagagactcttctaatgtacggccgatcgccattacttcacccgttgctttcatttgcgtgccaagacgtctgttggcagattcgaatttatcaaacggccagcgcggaattttagacacaatatagtcaagtgccggttcgaaggcggcataggttttacctgtgacagggttcatcatttcatcgagcgttaagccgacagcaattttcgctgcaagtttggcaattggataaccagttgctttcgacgcaagtgcagaagaacgactcacgcgcgggtttacttcgatgatatagtattgaaagctgtctggatcaattgccagctgtacgttacatcccccttcaataccaagtgcccggatcagcttgagcgacacattgcgaagcagctgatattcacggtcacttaacgtttggcttggcgccacaacgatactgtcacctgtgtggataccgactggatcaaagttttccatgttacaaacaacgatcgcatgatcaccgctatcacgcatgacttcatattcaatttctttaaagcctgcaatacttttttcaagtaagcattgtgtgactgggcttagcttcaaaccattttcgacgatttccttcagctcttgctcgtttgtacaaattccgccgcctgttccgcctaatgtataagctggtctcacaatgacagggaaaccgatttggttcgtaaacgccatcgcttcttcgaggttatggatgatttcactttctggtacaggctcatttagttcattcatcaaattacggaatagatctctgtcttctgctttttgaatagctgacagctttgtaccgagtacttcaacgccgcattcagctaatacgccaaggtctgataattcaacagcaaggttcaatccagtttgtccgccaagtgttggcaaaatcgcatcaggacgttcttttcgaatgattcgtgttaagaattctggtgtcagtggttcgatgtataccttatcggccatttctgtatctgtcatgatggtcgctggattggaattcacaagtacgacttcatagccttcttcttttagtgctaagcaagcctgtgtgcctgcatagtcaaactctgctgcctgaccgatgatgattggacctgatccgatgactaaaatctttttgatgtctacgcgttttggcatacttcttccccttctttctcagttgtatgaatcatgtccatgaactggtcgaataagtagttggcatcttctggacctggtgatgcttctgggtggtactggacagtgaatgctggtgcttctttatgttttaatccttcaattgtattgtcgtttagggcgatatgtgtgacttcgagcacatcctcgttaatggcactaactgtgtagccgtggttttgagatgtcagtgtcaccttgccagttgctagttctttcactgggtgattcgatcctctgtgaccgaatttcattttttcagtacttgcgccgcatgcaagcgcgaataattgatgtccaaggcaaatgccaaagagcgggacctttccaatcaattgctgaatcatctcgactgcttctggtacatcaacaggatccccaggaccgtttgaaagcatgattccatcaggctttaactgcagtacttcatctgccgtgatattgtacggcaccacgatgacatcacagtcccttttattgagctcacgcaaaatgccgtgcttcatgccgaaatcgacaaggacaattctttttcctcttcctgggcttgggtacgcatttttcacagaaacttgacttacttgatcagtcggaagctgcattgtttgaaggcggctaatcacgtcttccacttgttcatcaggtcccgcaaatgctccttttaaagttcctgcacttcgaatcattctcgtcagctttcgtgtatcgattccgctaagccctggaatgtttttcattttcaaatactcatcgagcgagtatgaagagcgccagtttgagggcttttcgcaaagctccttcacaatcagcccttttacaaacggtgtgatcgattcaaaatcatcacggttaatgccgtagttgccgataagcggataagtgagtgtgacaatttgtccgcagtatgatggatcagacaaaatttcttgatagcctgtcatccctgtattaaagacaacttctccgactgatgattctaagctgccaaagcctgttccttcgaatactgttccgttttctagcactaagcgtctcttcattttactagtctcccctcttcatacacgactttcccagatgcaagcgtcatgaccggccatcctgatacagtcaatttgtcaaacggtgtattttgccctttagataagaagctctttttatcgattgccatttctttgtttaaatcaatgagtgtcatatcagctgtttgtccttcttccagctttccataaggaagggagaaagcttctgctggcttgatcgtcatataatcaacgagttcttttaatgtccattcgcccgttttgacaaatcgtgtatacagaagcgggaacgctgtttcaagcccgactattccaaaaggtgcgcgctgcatcgtttcgttcttttcttcttctgtatgcggcgcatggtctgttgcgatgaaatcaatcgttccatctaacagtccctcgattagtgcctcgcgatcctcttttcctctgagcggcgggttcattttatagttcgtatcaagccctgggatgtctgcatcacataagagcaagtgatgcggtgacacctctgccgtcacacggatgcctactttttttgcatcgcgaacgactcgcacagattcttttgtactgatatgacatacatgataatgacagttcgctgcttctgctaaaagaacatctcttgcaatatgcaccgattcacaaatggacggtattccgtttaattcatttgcttttgaaaattctccttcatgaacgcatccgccgtaaataagcgagttatcttcacagtgtgccacaattgcttgatcaaggcttgccgcctttttcatcgcttcgtacatcatgcctgctgtttggatgcctaccccgtcatctgtgaaagcgaaggcgcctgcttcttttagtgctgcaaagtctgtcatctcttccccaatttgtctagttgtgatggaggcatatggcagtactctgacagaagaagtctcttcgattcgattcatgagccattccatttgctcttttgtatctggaactggacgtgtattcggcatcgctgcgatcgttgtatagccgcctcttgctgctgctttagagcctgtttcaatcgtttcctttttctctccgcctggctctcttaaatgtacatgcagatcaattaagcctggtgaaacaaatagccctttagcatcaatgacctcttctccgtcttctctttctaagtgaccaatcgcttgaatcacttctccttctaccctaatatcctgctgcactttttcacctgtgcttgttaagataaaaccgtttttaatgagatacgacatagacagaatctctccctttttgatgtagtctgctattttgaaaagctctttttaataccgccattcggacataaacgccattttccatttgcttgaaaattcgtgactgctttgattccactaaagaatcatctatctccacacctctatttactggcgctggatgcatgataatggctcgttctttcatgttgtttgccctgtttaccgttaatccataagtcgataagtaatcttcattgcccattttttcagcgtgccgttcatgctggattctaagcagcatcaccacatcagattgtctaatggcttcgtctacttggacatacgttccgtgaggattttgctcatcttggaaggaagcgggccctgagaaaaggactgtcgctccgagccttgagagtacttcagcattcgaccttgccactctgctgtgtttgatgtctccatgaatcgaaatcgttaagccctcaaagcagccaaactcttcatagatggtcattaaatcaagcagtgattgggtcgggtgctgcccgcagccatctccagcattgatgatgggaatcccaaccttcccgattagctcgttgtagtattcatcagtgctgtctctgatcacacatgctttcacgccaatggattcgagcgtttttaccgtatcgtataatgtttcgcctttttggacggaggtgcttgccgcatctaagttcagtacattcatccccagtttcttttcagcgacttcgaagctaaatcgtgttcttgtgcttggttcaaagaagaggtttgctacaaattctcccgctaagccaagctcttgtttcccttttttgagagccgttgcttcttcaatcagctgtaaaatctcttctttagataagctgctcattgtcgatagattattcattttttctgccccctctagtttttcatcactttcaggttcaaaaaaaccctaagcgtcggcagcttagggttctccaaaagaagcagcggcacattcgtgcattctgctcattttagaacccttgtcagcctcactggacttcttttaaaaggttttctgtattcgattcatttgactcgtcatcggccgctttttgctgcggcaggatcagattcaacaggacacccgtgatggcagcaagcgccattccagatagtgtgaggttgatttgtttcacctcaatgaatgccccgccaattccgatgactaagatgactgatgcgataatgagattccgcttttcttcaaaattcactttatgatcaatcaggattctaagaccgcttgaggcaatgatcccaaagagcaggaacgaaacgcctcccatgaccgcagacggtactgtactgattaatgctgagatttttccgacaaagccgaagcagattgcaaatactgctgctccgccgatgacgaagatactgaacactcttgtgatggcgaggacgccgatgttctctccatacgttgttgttggtggtccgccaatgagtgaagcgaagattgtcgccgcactgtctcctaaaatggagcggtgaagaccaggttttttaatgaaatcttgccctacaactttacttaacaccacttggtggccgatatgctcagacattgtcacaaaggcaaccggcaccatcaccgtgagaatgcttaatgtcacaacaggtgtgtaattgacaaatggtacgacgaagtctggtacagcaaaccattttgcatcaatgaccggctgaaagttcacaataccttgtgttaaggcaaagagatagccgcttataatgccgattaatactggaattaagcttaggaaacctcttaggaaaatcatgctgataatcgtgacagccagtgtgaaacccgcgaccgttaagtgcttaaggctgtatacaagctcggttgcattcggatcaacatacatcgccatgttaacagctgttccagcgagtccgagcccgatgaccataatgaccggtcctacgacgactggcggcagaagcttcatcagccaacctgtgccgagccatttaataaatagtgcaatgagtgcataagcgacacccgccatgaaggcaccaaccattgcggctccagggccgcctgttgctttgacattcagtatgggggcgataaaggcaaaggacgatccaagatacgccggaatttggcctcttgtgatgattaagtaaacaatggttccaacaccacttgagatgagcgcgacggctggactcatatcgatgatttttggtactagaatagtcgcaccaaacatggcaaacaaatgctgaaggctaagtgacagccatgtgaatggttttgggatatctcgaatgcctaaattggctttttgctgactcatgatttttcctcctagatgtgtccttcttcattaaaaaagcctctttgcgagtatgtgcaaagaggcttagaaaaaccgtacacgtcatgttaaccgtgctcagtgtctctgttattgccctctttgcaaactctctggaatgcatttaaaaaggttatttttcatatatagcgacaaggtcgttttgatctacttcattcagttgaaccatcactgtctctgcttttgatgtcggaatgttcttcccgatataatccgctcgaatcggcagctctcggtgtccccggtcgacgagaacagcaagctgaatggaagatggtcttcctacatccactagggcatccatggctgctctaacagttctgcctgtaaacaggacatcatcaacgacgattagtgttttgtcattaatgtcagctggaatgtctgcaccctttacaagcgggtcttggttgtctgtcttttttgtcaggtcatcacggtatagcgtaatatcaagttcacccactatgactggatttccttcaatttgctcgatgcgctctgcaaggcgctttgcaagatgaatgcctcttgtcttgatccccgcaaggatgacatctttcatccctttgttgcgctcaatcatttcatgtgcaattcgggtcagcgctcgtctaatcgcttgttcatcaagaatgactgctttttgttccatcttttacacctctttttgacaaataaaaagccccttctgcaaagggcagagaggggcgttcatttgtgcatacacgtgcacaaattgatccgttatccttctcagcctctctggactgttttaaagaatcttcatttcttcgttcattatttcaaaaaaagaacggcctgtcaatcgttatttcttaatgaatcgataaaagcttgcatatcggcaggaactggtgctgtgaactcgatatattcgccagttcttggatgatcaaatcctaaaacacctgcatgcagcagctgaccattgaaatcgactgtttttctcggaccatatttcggatctcctgcaagcggataaccgatatatttcatatgaacacgaatctggtgtgtccttcctgtttcaagtcggcactccaccaccgtgaaatcctcaaagcgttcaatcacatcaaagtgagtgacggcttgttttgaactttcttttgttactgtcatgctttgacggtcttttttgtctctgccaattggggcatcaattgtacctgtatcatgctggataatgccatgaacaacggctgtatatttccttgtgaccgtcttagccacaagctgattgacgagtgattcatgcgccatatcgttttttgcgaccattaacagcccagatgtatctttatcaattcggtggacaataccaggacgcatcactccattaatccctgataaatctgtgcaatgggccattagaccatttactagtgttcctgacacatgacctggcgctggatgaacgaccattcctcgtggtttattcacaactagcacatctgcatcttcataataaatatcaagatccattgcttctgcttctacatctagtgcttctggttctggaatctcgactttaatctgatcaccagcttgtactttgtaattggctttcacttgcttcccatttacttcgatcagcccatcttttacccactgctggacctgggttcttgaccattctggttctgtcgtgcttagaaatttatcaagccgttcacttgtttgttcttctgaaacggcaatatttacttgattcatgtagttgactccttcgttttctttccatctaacagcatttgaatgaagagcagaataacccctacacatagagaagaatctgcaatattaaaaattgggtagtgataattcccaaagacgaaatgagcaaaatctaccacttcctgacggaaaatgcggtcgataaagtttccaatcgctccgccaagcattaaggccagcgcaactccaagcagcttgtccttttgtccatgcttttgcaaataataaacaattcccgcaataacaacgagtgtgatcacatagaaaaaccacatttgtccttgaagaattccccatgcggcgcctgaatttcggtgtgacgtgatataaaagaagccatcaatcactggataagaatctccgagcatcatatttttgacaatgagccattttgttaattgatctaaacaaatcatcacgaatgcgattatgtaatagaacacacacgttcctccactttcatactttgatctttaagcattttatcaagaaaacagggaggagtaaagaaactttagttgacagacaaaaacctccctacatatggaaggcttcaaaatgagaatcatctgattcatgaggataaggagtgaatgcttttttctcgtattgcttatgatataaaaagtcgtcagccgtgcgggcggtaggaagaatactcatttgttcaagcggaatgatatcacctgttgcctcacatataccataagttccttgctccatttttgcaatagcgagagacacatcttgaagttcttctttgatgtgataaagaagcgtggccgtttggacctcgttcattgagacatgctcagcggatgaacgaaatgatgcgtattcaaacagtttagcttgaagctcttctttcatttgaaggagttccgtgtaaatcgtctctagatcgccattcatgtcgctatttcaactcctgccctgtcgtgataatcatattgttgccccggctgtccactttaaagccataagatttttcctttcgttctaaacgctgtcatttctgcaaacaagaaaacgccccgcatatggcggggcgctagttggtcatatcacactgttaattctggtaatatttttccacgatttcagcatttttcagtgacaatgttgggtatttcggatttgcaccaacatcttttgaaataatacgagaacgttcgcacagttctccttctgctttttgaaccacaattcgccctgaagtgtattcaggtgctgatgtgtcagcattttgcgcatcttctaccgttaattcagagatgataaagagctgcttcacatcttctttaatggatgcaagaaggtttttcacttcttctgtcgcataaagggtcacacttgcttcaagagaacgtccgataactttctcattacgtgcaatttcgagcgcttttagcacatcgtcacgcacttccataaagcggtcaaacttcgcttctgtcgcttccgcttgagaaacagccacaccttctggcatatctgttaactgaacacttggctcttcaacaaagcttaaatggctccataattcatctgctgtatgcggaagaattggtgcagtcagcttcactaacgccattaatgtttcgtagaagaccgtctgcatgctgcggcggtctggatgatccgcatgctcgatgtacacgacatcctttgcaaagtcgagatagaaagagctgagctcaattgtacagaaattgtgaatcgcatgatacacgaccgcaaattcgtaatcatcataagcctttttcactttatcaatcaatttgtttaatttgatcaagatatattgatccacttcgcgaagctcttctacaggtactgcattgactgctggatcaaagtcaaataggttaccatgcaggaagcggaacgtgttacggattttacggtagacctctgctacttgttttaagatatcatcagatactgggtgatcggcttgatagttgactgaagatacccaaagtctaagaatctccgcccctagctgcttcgctacctttgttgggtcaattgtattgcctaatgatttactcatcttgcgtccttctttatcaagcgtaaagccgtggctgagaacacctttatacggtgcttttccagtgaccgcaactgctgttgataaggaagagttaaaccagccgcgatattggtcagagccttcaaggtaaaggtctgccggacgaacaagatcatctctttcttctaaaacagcttggtgagaagaaccagaatcaaaccatacatccatgatgtcctgctcttttgtgaattcaccgtttggactgcctggatgtgtaaagccttctggcaatagttctttcgcttctttttcaaaccaaatattagagccatgttctctaaataattgtgagacgtgctgaatggtttcatctgtaatgaccggctcaccattttctgcataaaagaccggaattggaacgccccatacacgctgtcttgaaatgcaccagtcgcctctgtcacgcaccatattgaataggcgcgtttcgccccatgctggcacccatttcgtttctttaatattgtctaatagcgcttctctgaagtctttaatcgaagcaaaccactgagcggttgcacgataaatcgttggctttttcgttctccagtcatgcgggtaggagtgcgtgataaagtcgagctttttcagcgcgccttttgcttcaagctgttctgtgatggctttattggcatcctcgtaaaatagaccttcaaaaccaggcgcttcttctgtcatgacacctttttcgtctactggacatagtacgtcaagaccgtacttcatgctgacaataaagtcatcttccccgtgacctggtgctgtatgaacacagcctgttcctgcatccgttgtcacgtggtcaccaagcatcacaagtgaatctctgccatagatcggatgctctgcaacgacgttatctaattcttttccttttaatgttttcacgacttcatactcttcaaaaccaagcgtttttgccacttgttcaactagctcagatgcgacaacatatcgctcagcacccacttgaagaacactgtattctaggtttggatgaacacaaatcccaaggtttgcaggaagtgtccaaggtgttgttgtccagatgatgaattgttcgccattttcaagtacgcctttcccatctttcactttaaatgaaacgtaaatggatggtgaacgtttgtctttatattcaatttccgcttcagcaagagctgactcacttgaaggagaccagttaacaggctttagtcctttgtaaatgtagcctctcttcgccatttctccgaagacaagaatttgctgcgcttcgtactcaggctttaaggtgacataaggattgtcccaatctgctctgacgcctaatcgcttaaactgattgcgctgaccttcgatttgtttccaagcatactcctcgcatagtttgcggaattcagctgtcgacatttctttacgtttgacttttttatttttagtgagtgctgtttcaattggcagcccgtgtgtatcccagcccggtacgtacggtgcatggaatccattcattgatttaaaacggacaataaaatctttaaggattttattgagggcgtgccccatatgaatgtcaccattcgcatatggaggtccatcatgcaaaataaaggtcgggcgtccttttgtccgctctaaaaccatttgatagatgtctttttctgcccactcctcttggatttcaggctctttgttcggcaagttccctctcattgggaattctgttttcggcattaataaggtgtctttgtagttcatacccattcctccatatgcaaattctgattaaaaaacaataaaaaaagccctctcatcccataagggacgagaaggcttgtctcgcggtaccacccttttagacaagcgctatttaatcagacgcttatccactctaaaatcgtaacgtgatcagacgccttttcttactcattcttttcagaaaaggaactaaaggggtgatctcattgcagcatctcgtaatgtcaggcttccaccatccctgattcgctttattacgcatatgacaactgcgagtgtccctttcaaacgtttatctcttgttaatttatgatggtattatatgcaacttgtacacgtcatgtcaaggtgatgcgcttattctttttcgtcaaagacagcgtcaacttcatattccagtaaatgatcccaatcgtcattttttagaagatcaagctgagcttcgatgagcatttggaagcgagttctaaagactttcgactgcttcttgagctcttcgatttccatcgcaatctttcttgattttgatagcgcttcgttgataatacgatcggcatttttctccgcttcacgaataatcaatttcgcttctttatcagaatgacgtttgacgtcttctgctgcttcctgcgccacaagaattgatttgtttaacgtttcttcaattgtcgcaaaatggcctaatctttcgtcaagctcgtttactttttcttcgagttcattctttttgcgaagcacgatttcataatctttacgtacttggcttaaaaactcgtttacttcatcttcgtcatagccgcgaaagctttttgtgaacgttttattatgaatatcattaggtgttaatggcaacctcgccacctccagattcaagttcgttatgtcagaagctcaaatgttactttaaatttatcttttttggtcttcccatcaatcgttttgaggctaaagcggccaaatcccctgacagagagctgatcgccttcaccgattgtaaaagaagggtcctcagtgactttccagttaactttgacaaacccatttttgaccaacagctgtgccttttgccgagactgacggctgattgcagcacataccgcatcaagccgcagtgaagaaatcgtatcttctttgatgtcagtcttactgataaccggctttaaatctgcctgcgtgatttcctctaatgatacggaggctctgccgacatgcgtcagctgcgcacgaacaaaatcggcgacatcactcgtacaaataaactgcacatcttcctctgaaaataacagatctccaaatttttgacgcttcaagcctgtcccaatcagtgaaccaaggagcttcgggtgttctagcgaaataaactttttcgcatagttcacctgaaaataagacagttcagcatcctgagtagccggttctaaatattcaggataaatgagcgctcttttgcgctccgctccttcatacccgccaaaaaacatgatcccaagctcatcagcatgctggatgacggactgggtaataaactgctcacgcggatcaagaaagtctgttaatttcattcgatactggtcgagtgcgatttttttccagcctaacacttggtcgacaaatggctgttcgtcttttctaaaatgttgataaatatcgctcattttgttcccctcttatgtaaaagagcctggcagcgccaagcccggcagcctgtctacatgaagcgtacaatcatattgtaaagaccagttagtccatatgatgatgcaaaacgaatcacaagcaatgccacaattggcgaaatgtcaatcatgccaattggcggaataattttacgaaatggttctaaatacggttcgcaaatatttgtcagaaaacgcccaattgcagtttctcttgcagatggcacccatgacataaagatgtaaataataatcgcgaatgagtaaatcgttaataccgttcctaaaaaattaaaaatcaaatttagaatcactatgatttaccacctctgaggttcttcctctgtcaaaagttctgatattgtgccagatacatccacattatcaggtgtgcagaggaatatattcgagccaatacgctggatgtctccaccgattgcataaacagttccgcttaagaagtcgatgattcgctttgcttgatcgtgctgaatgcgctgcaaattgacgacgactgcacgtctgtttttaatatggtctgcaatctcctgcgcttctgcataaacacgcggctcacttaacaccactttagaggatttctgcacgctttgcaagctgacgacattttgtttcccagtctgcggacgctcttgaaatgccgctttgtccttcgttcctttttcttcttggactggttctctttcttcatcaatatattcgtactcatactcttcatcgtcgagagtgaaaaagcttttaaacttattttttatgctcatgtcacgcacctcctgtttcatttccaacaagtgaagagccaatccgaacgaatgtcgcaccttcttcaattgcgatttcaaaatcatttgacatgcccatcgataaatgctgacaaggtgcatttacttggttaagatgttttacttcttcttgaaggttttttaatgttttaaagcagtttcgtatcacagtgtgatcgtctgtaaatggagccatcgtcatcagtccagcaatttcaatctttttgaaatcagcgagctgcttgacaaatggaatcacgtcttcactttgcaggccgcgctttgactcctccagtgatgtattcacttgtacaaaacagcgaaccgtgtgatccgctcttttttcaatttcattcgcaagagagatcctgtcgagcgaatgtaagtagtcaatggtctgaatgacagattttacttttcgtgtttgtaaactgccgatgaagtgccagctaatgctttcatcggttatagccgcttgtttttcaagtaacccttggtcacgattttcaccaaaatgcaaaattcctgcttctttggcttcttgtgctcgttcaattgagacatattttgtgacagcgacgactgatacatcgtctgggtttcgaccggctcttttacatgcttcgtttatttgttcatttatttgtctgagattctctcgtacattcaattgctcttatgcctccttaaacccgacaaaagacatcatacgtcctgttttcccttgatcacgccggtgtgagaagaatagctgttcattgcagcttgtgcacatcgaactgacatgtatgttttcttctatcatccctgcatgaagcaatacgtttttgtttaatgtttttaagtctaatttatattgtccttgtgatatctcggaatacacatccactgtagaaaagggaagctgtttcacttgattcaagaccacatcatcaactatgtagcagcagctgccaatggatggtccaatgacgacttgtatttgatcggtcttagcaccttcttgattgacccatagatctaccatctttgcaccaatttgcttgacggttcctttccatccggcatgggctgttccgatgagtccatgttgcggagctagaaaataaagcggaacacaatcggcgaaacaaagagcgagcatgatgttcggttcagacgtatataagccgtctgttccaggcaatgcctcatgataatgaagacttcctcttcctctttgctccttggtgactttcttgatgcggtcctcgtgtgtttgatctgcaaacacccaatcagagagcggcacagcagtagcatctgctatgacttgacgattcatttggacactagaagcatcatctcctacatggagtccagtgttcaatgattgatatggagaaaggctgaagccgccattttttgtcgtaaatccggccaatacctctttaccagaacatgtcatgttcgtccaatcatgaatcatcattgcatcaggtgatttctgctgaaaggggtcataattgtgtgtcaaagctgcctaccacctttcattcatctctctttatatcgctcctattttaccacaagacatgcgtagacagttagtgggattcattaaatattacactcaaatgtgccctttctacaggtttttttgcaaattgatatgaaaacgtaatctttttacccgaaaaagacattgtttgctgagaatggagagcttatgttaaggatcattgaataattcattgaggagttatacgaattttaagaagacaatcggacaagtatcacatcttcgccaatttttactatatttcgccacggcacaatcatttcctcttcttttccgaaaaatcccatcattttacctgtgccgccgataatgattgcttgtattttaccgctcgtaacattgatatcaatgtccccaatggtgcctagtttttttccgcttgacacatcgacaacatccttgatttggaattcagaaatactgatcatctgtccttccccgcctttcgttttctactataatatgtatgatggaaaagcagggacgcagaccaatagtttcttttatctacaatttacttaagtgaggacggccatttctccacatcacatctaccgggcattcaaagaaggaagaaagcaagtcgcttgtcatcatctcttttgttttcccttgatcaaaaacagacccctcttttaataatagggtgtgctgaaaaacaggcaaaatctcttctgcatgatgggtcgtgtaaagcaaagtaggcgcatcaggctttgaagcaatgaatgagatggtctctagcacctgttctcttgctaaaaaatcaagaccggtcacaggctcatctaaaatcaggagcttaggatcattcattaaagccctcgcaatcaggactttctgcttttctccttgtgagagtgtttcatatgtccggttcgcatatttgaacgaaccaaatgcttttaatagatcaatggctttctctcttatctcatctgtcggggtttcataaagcccgatggaggcaaatgccccgctgataacaatttcaaatgcattgtcgtctctgtgcagtttcttttcaagtcccgcagaaatgaggccaattttcttcctgagcttttcgccaagagcctccttgccaaagacatgtcccagcaccgtcatctcacctgatgtagggaaataatatgagcagagcatatttaataaagcggttttccccgcaccatttaaaccataaagcacccagtgctcctctttggtcacctgccagtcaacagactgaagcaaccattttccatttcgttttaaagaaacattctttaattcaagtgacaccatcatttcctcctgagtaaaaattctgaataaacaaataatgaatgtttacagcatatcgcaattgctctttctggtaaacctcatataaaaaagctgctccttttgaggaacagcttttctttaacgttacgaaatttcaattcgtacgccttcttttatatcaggaaacgtgtgcggagatgcaaagacagctcccggtaatacatcatcaaacggctcttggaagtagatcgaaatatggccgagctctttaaagttgtcatttgctttattgccgagggctgtgatcgtgtacgtttgatcacccacttgaatggtaccgcccagtttcaacggctcttcttctaaatgttcgaactcatgaatgacggacatatctcttaattcctgcggcgctgcgggtccaaataaaacaatcagcttatcttctttaaattgcgggactaaaatcccgatttcttttacgacagattgtgtgaccatgtatctcgattcctcctttaatacgtttaatacataccaaagctggcagcgtatgcgatcacaacagatagaacccctgtaatgagacggctatacaaaacagctggtactccatattgtaccgtttccggcttcgcttcaccaagtgatagcccaactggaatgaaatcacaccctacttgaccgttgatggcaaatagtgcaggaagtgcaaattgaggcgggatattccctagtgcaatttgactaccaatgagaacaccaattacttgtgcaatgactgcaccaggtcctaagacaggtgataggaatggcaatgtacaaaccacaacgaggagtaagagtccccatatagatcctgccagtggtgatagaaaatgggcaatcaagtcaccaatttttgtataattgataattccaattaacatactgacaaatgccatgaatggaataatgtttttcaaaagcatatcaacggaatcacgaccagcctgatagaacgtaccggtgactttcccaattcctcttgagaacctcatcaagaaattacctttttcctgacgctcgagattttcctctttcagttttgaataggtttctttgaaattctctttgtcaatcggctcactgttaccctgaccttctgctgttgcctcaccacttgatgcatccgcaaaggaaatatctttttctgtgacgcctgatacgaagatatcctctgtaatatgttttgcaagcggtccagaaggagaggatgccaaaacgtctacagttggaatgcgcttcattggataaagtccgattcgcgcggttcctccgcagtcaatgacaacacacatcatttcatcttctggtatcgagtttttaaagccatcacatgcttctgtccctgtcatttctgcaattttacgtgcaactgggtgaatgcctccccctgtaatggaaacaacctttctttttttaccggttggttcaagctccaagccttggccccatccgccagcaccttttgctacaaatactttgtggtttgtcatgtctaaccctcccctattgtgaattcgctttcatttttcctgctaagtactttgtaatccattcagtaataataccgcgaagtaaaatgacgacgatcccgactaagaagtaccgaacagcaagctctgacatagagtaccctgcttctttaatcccgttcgcaatccctaagtagacaaacagttctcctgcgttggcatatgggaacagtgatgtcaccggatgaacaaatgaaacagctgaatcatagaatgctggtttttgtttttcgggtaagaatcggccaaacgtataagccattgggtttgtcaaaataagaacggataagatcggcattaacgtgtagcgcaaaatggtatatttcgcagcaaactgaattgctctattcactcgctcttctccaataaacttcatgacagcataagtgaaagtaagtaacacaacaagcgttggaacgatacctgtaacaagacccatgaattgctttccgccggcttcaaacattccgataaagtgctctccaaaccattgaatccattccatgtttcatctcccctttctttagttcacatttgttatattttttttcgaaatcgagacaagtgcctgttcagccgccatggaaagtgcgtgcatgacagctggcccctttttgcgttttttcaacgtctgcttcatcatatggtgctcgtctaacactgcccctacatgctttccttcatatgaagggacttctttaaatttagataagatcgacacaccgccaagcacatggcatttttgaatgatatacgattcatctacaatgatgagcgcaatggccccagggccaactttgcgccgctccattcccgaaaataagtggtagccctgcttccctctgtaatcatcaataagtgaatccatgctcttgcggtagtacttgatttgaataaaagataacccatactgcacaatgagaatgatacaaagtacgatcgctaatttttccacagcttcacgcccttatgattgaaataaatgatcttgtaatgaacgcagcttccagaccgttgtgtttgaatcaagctctacatcatcgtgagttaggaattgtcctaatttgatgtcttttttcgctacgacttttccgctaattaagccaattggaatgtggccgttcgttttcatatcttgatgtgtttcaagaacacctcttactgagtatccaccaattccgtcaagtgattctccagctttaatatctcttttcgccacagcgactgtttctgacactggtacaccaattgggtgaatagatgaatcatgctgtaagaccgcttttgcgatggtaacaggtgtttcaagactcgctaagtggaaaggacggtaaagtgtgtagtgtgggccttttccaacttttaagtagcgcagctcttcatctactggctcaaggtcactcttcacgatgacaaatacacctggtgcaagtccatttacatattcaacgaccccgaagttatcgagcacgccgccttgctgtttttgattcaatttatctgcaacattttctaaattcgcttcgactccatgcataccgactttatctggcagaagccctgtcgcgttacttaataagttcatttccgccattgtttttgttccgtcttggaatgcagccagcatatgtgcactcatatgtttactatctgcttctgctttacacgtatctggatttgcctctgggaagaatgggttgttctttcctttcccagcaacgagtacttcaagccccattgttttcgcaaattcatataattctagtgttgctgctggttcatctccagctgatcctgagtaaacaagtcctgcatttgtgaacaacttatgcatgaccaatccgatggtaatatcaacttctacatttaaaagaacaagatgtttttttgaattaagcgcttccaaagaaatgtttgctccgacctctgggactcctgttgcatctacgacaacttccacggaatctgattgaatcacttctctgtaatcatttgtgacaaccatttgatgcggctttgcatgctgcttgtaaaaattcgctgccttctctgctgcactaaggtggatatcacaaacaccagcaacaatcatgcctggaattttagaaatttgtgaaatgagtccaaagcccatttggcctgccccaataatccctactttgattggatccccactacgttctcgcgctaacaattgttgatagattgacatctaaatcatcctttcaggttttcttgcttctcgggtagattgctagaaatataatctgaaacttttaacaaatgttataaaaattaacaaaaatctgtttcttgtaacatttgttattttatttatcatttgttatgaacttagtttatatgatgtgtcaactttgtgtcaagctaaaatcgataaaattttcaatctttttgagtctaaagactcaaaaaaaaaactacctaatatcattaggtagttactttaataaggcatctccagttcgttcatcggtaattaatacatgaattaatccacctgctaatgccgcctgaattgcttcaattttctcttcaccgccagcgacacctatgactagcggaatttctttcagcttttgcgggcttatccccatcacccggtcgttccatggatggggatatacttccccttgatgatcaataaagttatagcaaatgtcacctgctacatcctttgcttgaaggatgtcctcttcgccgcttgtcatataagatttcaccatcgttgaatgctgcggaacaccaccaattccgacaaccgcgatatttgatgattctcctagttcaatcacttttttgattgacggctgccggatcaggacatctttcgcttctttcgtatcaagcatgacgggtacatgtaaaaactcacatttagatttgagtgcctcagtgcatctcgcaataatatagttggcgtggatatcgacatcttcatttcccacacctccgacaagcggaacaaatgtcacggatggatagtgctgaacagacgtaagcgctttcgccatttcatgcagcgttgtccctgaggaaaaaccgatgacttgtccatctttcatcacttttaataaaaagcttgccgccgcggctccgattcggcttttggttgtgtctttgctgagtgtttccacacagacaacttctcgcagcccatatttgcgttctatttttctttctaacgatccatactgttggttgacttcatcatgaataatgatttccacgattcctgcttcacgtgcttttgccaaatatttcgatatgagcgaacgactaacccccaccgcttctgcgatgttagattgagtggcgccttcttcataatacatatgcgcaaccttaatgagcagccttctttcatcatggaatgtcataataacccttctttccgcttaagtgttccctaacaaatgctatctaaaataacatttgttaaaaacagattaaatgaaaaaaataacagagtcaatactagaggcgtgttctctcataagaatgaaaaaagccgcacatgaagcggcggctttaaaagatgtttttattcatttgtttaatggctgctttttcaagcctcgagacttgtgcttgagaaatcccgatctcctcagcgacttccatttgcgttttgccttggaaaaagcgttttcgaagaatcattttttccctgtcgttcaatctgcgcatgccctcttttaaggccaattcttccacccattgtgtgtctttgttccgttcatcactaatttgatccatcacataaatcggatctcctccgtcattatagatcggttcaaacaaagagacaggatcttgaatcgcatctagggcaaaaacaatttcctcatgaggcacttccagcactttggcaatgtcttctgcagttggctccttgcttgtctcactaatcagcctctcacggacctgaagtgccttataggcaatatctcttagtgagcgagacacccgaatcgggttgttatcacgcaagtatcgacggatttctcctatgatcataggaaccgcataagttgaaaatctgacattgtggcttaaatcaaaattatcaattgatttcattaatccgatacagcctacttggaagagatcgtcgacatattcgcctctgttgttaaaacgctgaatcacacttaaaaccaaccgtaaattgccattgactagcttttctcttgctgtatcgtcaccctcatcttgcaactgtctgaacaattttctcatctcgtcgtttttcagaacaggcagcttggaggtgtcgactccgcagatttccactttatttctggacacttttttccctccctacaggagctgttgtacaaagttcagtatctccttgggatggaaaaatatgcacgagcgatgacgagaatcatgagaaaaaaggttatttcctttgacagtgcagggacagagcttttttttaaaaattttttagaccattttattaaattctttttgtaatcgtttaatgattcgtttttcaagtctcgaaatataagactgggaaatcccaagcatgtcagcgacatctttttgggttttttcctcgccgccaactaagccaaatcttagttccatgatctgcttttcgcggtcatttaattgctctagcgcttttttcagcaattttttatctacatttgcttcgatatcccgcgtgataatatcatcatctgttccaagtacgtctgataaaagcagttcatttccgtcccaatcaatgttgagcggctcatcaaacgaaacttctgaccggattttattatttcggcgcaagtacatcaaaatctcattttcaatacatctcgacgcatatgttgccagcttgatctttttttctgggttaaatgtattgactgctttgatcagaccaatggttccgatactaattaaatcctcaatattaataccagtgttttcaaattttcttgcgatgtaaacgactaaacgcaaatttctttcaatcaaaatcgctcttgcggtttgatctccctttggtaatttgacaagcagctcctgctcttcatcctttgataatggaggcggcagcgcttcacttccaccaatataataaatttcatcactctttagacctagcttcatgaggagtttataccagtagtaagtgagtttaaattttaattttttcatcttcttctcccttctaaatgtcaagttgacctcgtaagataaaagacatcaccaaaaactacgacaccccttggatgattttcccgtctaacatatctggatgaatgatggattcaaattcctgatctgccgataaaccgctcagactcaaccctacaaaacacttagcaggctgaatcatatgcgtctttgaataaatgaagactgtatctggttttaggcatagcagaaagccatgatcatgaccgactgctcgatatggaacaagtcttaatcgatcaagaagaggaaattgatcatcgatcttttgcatgacttcaacaggatgagactgtttcatgagctctataaatggctctccgcaaatggctgttagctggtcagcctggacgatcatgaccggtgtttttgtcataggatcatacagctggttgccagaatcgacgagtccctttaaacgaatggtttctccatgaatgtgtagttccacaagcacttgttcatcatactgtctttttttcgtaccaacctctcctaatcttttctttgaaaacagccaaatcgcaggaaacccagttaaaacaaaaagccagctaatcggatcaccaaagccatcattttgtgaaatcagcagaccattttgaatcactgtattggtttgcaaaaatgaatgaaccccgatcatgcctcctcccatcaaaaaagttacaaagtaaaaagcaaacagattttgaaaaaaggaacgaaatctttgaaaaccaaaggttgcaagaacgatgaagatagaaaaaagtagtttgcctaaagggtgtgacacaaccattgcaaatggtgtaaagagcaagagaacaatgctcgatccaatgagcgctcctaacatatatcgccttttttttacttgtcgtttgagaataaatgcagtgagtaagagaagcaatagatcaaaacaaaagtttaacagccaaatcacatctaaataaatgaccaccttctgctcctttcatctgaaacaaagaatcaaaagcagtacttgcacttgtttgtaccagtataaaacagtcatgagatggaagtctgtcaattcttgttggggatgatagagaacttttggtggattgttattgtttttgtcgaggaatgagagagagtattcttctggacaagccatcaacaattgtttgaaagaaaaaagacacgctcctagaagtcgtgtcttttgtttatattatttttcattgatgtttaatgtacctgaagctttttgtcttgtgacatttccataatcatctcgcacaatgacttctacgaccgcaccttttgctttagcggtagaagttgcagtccagtaaccttcatacgttccgctcgatacttcgcgaagcggcagctctgtagtattttgaagctttgatctcgcgtttgtcagcggcatgtgaatgacaaacgttgcgtctagcttttctctactatgaaatgaaatcttaacagactcccctgatgccagatggacattatctgctggagtcagcttagaaatctcaggtgcatcgtattgaacatcgatattgatttttttagtcgttttgtttcctgctgcatctttcgctgtgactttgatcgcattttccccgttctcaagcagtattcttgcggaatacttcccttcttttatggttgccttttttccatttacagtgacttgatcaagatgatcatctatgacctttccttctacagtgaacgattctttatttgtcttttccccttttttcggtgtatcgatagtgagcagtggagctgtttgatcaatgatcagatttactggtttggatcgttttgttgcgcctttatccgtaacagttgcagcagtgaatacatgctctccgcttgatactgtgaccttttctttaaaagcgcctgactgatctgctttcactttggcaatctcttcatcgttttgatagatcgctacatcaagcccaggagaggctttgccttcaatttctagttcatctttgttcgtaatgattcctgcctttggagatgtaatctctggcacatctgcttcatagtcaacaagcgcacgaatcatataattcccctcttcttttggagaaggagaaaaagcaccgcttgtcaactgccagcttctttcagcatttggtccatcctcatcagttgcaaggcctggagattccgtattctttttcgtttgaatatagacaagatagaaatctccatccactgtaatggcttgatcttctaaatctacttttgtccattccccattacgcagcgcattcgctttgagcggtcctgcaattttctcccctggagctccgttcttcccagaagcgtcatacacttcaaccgcaaagtcattccctccaggagctggccactctgatgaccagaaacggaaaagccctcctgtgagttgcgcttgtttcttccccttttctaatgaaaacttcacagcccagccattaccaggatcatagaaagctctcgcattttcagctgttccgtcatcgtagccaatttccccagcaaagccgatgaatggttctagctgaatggctttttccaccggcttttctgtcacatctgctgtaaaagaatatcctttaaaccctttggcaaatactttgacggtatagacaccgcttaatgcctctagagaaaattcaccagattcatttgttttcaccggcttaattttcgcatcctctacaaggtaaaccgtggcatcctttactttttcacccgttgtttcattggcaattgtgccagatatcgttcgtttctttagtggctgtaaggcgaaattcgcctctgctgtttcttttgaagaaatatggacggtttgtgtgcgtgattcaaatccgtaagcttcggctttcactgtgaattctcctgcactgtgaggaagctgatatctccctgttgcttcatctgtgtacgttgacttgccgctttcaagaacactgatttccgctttcataggaagagctttgatggacggagaagctagatttttttcctttttcttttcttttatgttcgcaggcttcttatatggatgtacagccttatcttttttaggcatggcttgatctggtattttcatctcatctaaatgaacatcttcgtttgtcacctgtccttcaatcatgccaattccatctgttaatgccgtaattgctgctcttgcatcaactaaacctgccccatagccattgtttggtgactccgggaattgctgatcagttaacggcttcgcagtatcaatcagtatttgttcaatctcttcaacagaaagatctgactgtacttggcgaagaagagccacaacagctgaaacatgcggaccagccatcgacgtcccattccagccatcctcataccctttcccaggaatggatgaacgaatgtttacccctggggccgcaatgtctggtttcatgacaccatatggagacggaccttgcagtgagaaagaccccaatttgttattttgatccgtagcacccgttgcaaaggcctcttgatagttcgcaggattcgcaatggatccttcaccaccagggttgaatagatcggtattgcctgctgaaaactctgggaagatgtccgccgctctccaagcattgacgacatctttataccaatcatcaataccaggcccaccgccccaagaattattgacgacatctggtgccttttctggatgcgggtttcccgcgtcatcttttggtgctaaaatccactcacctgcatcaagcagatcagcatctgtaccaccatcttctgagaaagctttcaccgcaatccattttgctcccggtgcgactccgatttgattctttccatctggctcagagccaaccatcgttcccgttacatgtgtaccatgctctaaatcatcatatggcgcttcagatcctgtcgtagcatcgtaccaattgaattcatgagttggtccattcggatgtgctggatcaaatccgcggtatttttcctttaaagcaggatgttcccattccgctcctgtatcaatacttgccacaactgtaccagtaccgtcataacctaaagcccacgcttctggagcatgaacttgagaaatgttccactcgaccccatctactgctttcatttgttttttctgcttcgtcttcaaatcaaccggccggtgaatttgacgggtttcgtttggcagcacttgatctacttctgggaaggcagccacctgttccataacttctttcgttcctgtcaccgctaaaccattcacaatatagtacgaatgaatctccttcacttgctttttcttttgttctttttgtaaatacgtaagaagcgcttgctgcgtctcctcagacgttgctcttaattcagatacgacagctgatcttttggcgtattgcgttttagccgctgttaatttctgttttttggctttggataccgcttccttcgccactttttgagtatttgtttgttctttcattttgattaaaaatgtcacctgatcatcctgctgaaactgtttcattaatctagatgagatctttgcttttgttgtcttagaggagacagcttcctcctgatatgaggtagaagtcgattttgcttgaaccatcccaaagcttgtcatcgttaaagtaccaatcaccaaaagactcatcaaacgatagccggcggtcttgcgaaacttcaatttcaatcaaatccctcctcctcaaatggccaaacagagtataggtctcactcctttccttctgttgttcatgacaagattcatggtgttctatttaatgtagtcaaataaagttcatcattttgtcgttttttgtaagagtgagtgaaaatgattcttttttcttaaataccataagtcaaattacatatggaaattgaagtgactttcactcatttaagactttttgattagatcctcttatacgttgaaacatgaaaaaaccccttccaatggaaggggttaagcgatactcgattagcgtttattgcggttgcgtaagaacgttggaatgtctagcgtatcatcacttgattgtgtattttgtcttggctgagatgatggctgttgatgttcctcacgtttcacttcacgtttttgaggaatggattgattttgctttaatccttgtcctaatgggtttctttgtgattttgtcacttctggttcttgctcaatgaatccagtagcgatcacagtcaccacaatttcatccttcaagttatcgttgatgacagacccgaaaatcatgtttacatcttcgtcagatgcagaagccacaatatccgctgcttcttgcacttcataaagacttaggtttgtaccacccgtaatgttcatgatgacaccttgagcaccatcgatcgctgtttctagaagtggtgaagaaatggctttcttcgcggcttccgcagcacgattttcgcctgttgcgacgccaatacccattagagccgaacctttattggacatgatggttttcacgtcagcaaagtcaaggttaatcagacctggtgttgcaattaaatcggaaatcccttgaacaccttgtctaagaacgttatctgccgcgcggaatgcttccagcattggcgtgtttttatcaacaatttcaagcaagcgatcgtttggaatcacaattaatgtgtcaactgcttctttcatagaagcaattccttcaactgcttgaagctgacgttttcttccttcaaatgtgaaaggacgagtcacaactccaactgtcaatgcaccagaatcttttgcgatttttgcaatgacaggtgcagcacccgtaccagttccaccgcccataccagctgtaacgaagaccatgtctgcgccttttaatacttcttcaatctgctctttgctttcctcagcagcttttttaccgacttcaggattcgcacctgctccaagccctcttgtcagcttagcaccgatttgcattttagtttctgcttttgatagatttaatgcctgtgcatcagtattgactgcaataaaatcgacaccttgtacgtcattttcaatcattcggttgacagcgttattcccgccgccacctactccgattactttaattgatgctaggccgtctatatttgtttcaaactccaacatgctgaatcctcctaatccgtcgaaaatctaattctattcccagaacatattaaatagttttttcattttgcccggttttttatttgtctcttgttgtgctttttgttttactttcggtcttggctgcgcttctttcacttgtggtgcagaagaaaccggctccatggatgcgcctacttcatgaaacgcctcatctggcatttggaatccaacctgtctgccctgaatctttgcattgcgataagcaaagtggatcagacctactcctgtcatatattgaggctctctcaccccgatataattcggacttgcaatcctaacattgttttgcaaaaccgtctgtgcaagagaaaggatacctggaatggctgcttgtccacctgttagaacgaatccaccaggcaaatcatggacacccatatttcttaattcctctgccacaaagagcaagatttcctccagccgcgcttcaattatgttagccgcatcaagctgtgtatacgtttgtttttgatcggtaccgatcacagaaacttcaaatgtctcctcagtcgatgcctcatcataaaacgcatgcccaaattgttttttgattcgttcagcttcttcagtggaagttctaagtcctatagacaaatcttttgttatgttctctccgcccaaagggatactgtgagtagaatagagatgcccgttttcaaatacggaaatcgttgtagaaccgccaccaatatcgacaagagctactccgagatttttttcatctttcgataatgctgctgagcccgatgcgagtggctgcaagcatatatccattatttcaattccagctctttctacacatcggagccagttatgtagaatcgttttagaacctgtaattaacgatccttccacttctagccgaacaccaagcatttttttcggatctgtgatctcatctcttccgtcgacgataaattgtctcggaatcacgtctacgacgagatgttcttgaggaatagatactacttgtgcagcatctaagacacgtctcacatcttcagcatgtatttctttgttttcactagatactgcgactacgccgctcgtattctgaatatgaatgtggtttccgttaattccgacaatcgccttttgtaaaggaaaacctaccattctctcagcctgttcaaatgcttgtctaatagaatgaactgtctcatctatatcaacaatcgatcctttttttaacccctctgaagggacatttccaacacctataatgttaagcgaatcatccgccatttctccgacgatgacttttatattggatgtaccgatgtcaaggctgacgtaaatttcattgttgttcattctatggcacctcctcacatatcaatactttctattctattatttgctgaacaacaatacaatgaatgtgtttttacaagtgtgtaacaaaacttaaaaaatcaacattttttattaggattactgaaaatattcgttacatcatatgtatatccttttttatgactcactttttttctttttttctctagaaattgtccattttgttagtagaattcttctgataactgctatattttgaaacaatctaacgccgaatgcaaacattccgactaagtacaagtctacaccaagatggacgcccagaaaagctaaacttattgccagtataatattaaagaagaagcctgatacaaacactagttcatcgtatgccccttgcagatgtgcccggattccaccaatcaatgtatcaagcgcagcaagtacagcgagggaaagataattagaatactcattcggtatcgtaaaattagttaagaaaccgatcgcaactcctatgattaagccaagtacaggtagccacattaagattttccctcctttacatcgtcaagaggcttcaattcgtttacttgaattgcaccgtcatatgcttttaagtggatttttttcttcggctggctcattctcaagctgaagttttcctgagcaaacaaatcaccaatatctgatacatttaaacggctgtataatttgtcggcctgctcactaatcattttaatgatgacttcatcactatctaagctgaagccatccatttttgttgtgccattaatatctcgaatgacacttgtattaatgacacggcgatcattgatggaaatatgttttgccccaaacatattggcttcattaattaattttttcagaagatcaggtgggatgtttttcacttcttctccggtaaggtccttggaaaaaagctgagatatttcaatttcaatcccctccccttccacttctgtaaaaccagccttttcttttaaatcttttaacgtttttgttaattgagcttcttttgatcgatctccttgatgaccatatttttttagcatctcgtcatatttatcaatttctttcagcaaatccaattccttacttttagatgcggataaatcctctctcagttcccacacatcacgagtatctcgaactttgggcttttgtaaggaattaaattggatggagaccatgatgccaaatatgatcattaaagctgttaaactaagtaaaggcttctttttcctcaacaccactcaccttttcacttttaatctttgtttcttaaaagagggttcatacgaatatccgttttctcaatcgtcattgaaatgtgatcacttgtcagctgatcgaccactccccctgcaatatttaaagcaggtattaacacagctggatcaccaatagcagatatgacaaatggtgctggatgctgaacaccatctactgtgacaactggaccgttacaatgtatgtatgattggtgtgtgattctttgtccattaatagatacagcagaagcacctgatataaatagttcgtttatcacatgaaaaatatggctctcatgcacaatgtaattattgacattttgtccactcgggatataagatgcatcttcaagagacacttttaccccttttccttttacaccgatctctcctgtaaacattctgtatttctcaacatcttccagtacattaaaatactgctctttttcatttttcaaattggactctgttgcttgtacctttgattgaagactatataattctttttcgagtttctgattcgccttttcttgcgttgtgagctgacttttcagggagtattcttttttccattgctctgtccgaatgacatctgcctgatgctgctttgtatattggtatgaaaaagatatcagaaaaccaagaacaagcatgacaagtgagaatataactgttttgcccctcaacgctcatcttcctttttcttagatttaaacgcttcgaaatacgtagcgacttccatatgaattgtgcctttttcagatggcgaaagctcttttacaatggctggataggttttcattttatcaccgaatgttttaattgaagcaatcacagtgtttccgtcattcatataaaatttcactagccacttgtttgaattggtcggcacataatatacttctgagatgagttcctgaatagaggctggcagctgatttaaagatttaacggtttgcttcagcttctccttattgtcccaatcaacaaaaataggtcctgcatgactcggtgtcacttcttctggtaaagcggtcccattttcaagaagctcataatatagatttcccttttgaagatacgcaatatttgcatattctttgacagtaatacttactttatttgggaaatgctttttgatactgacacttttaatcaatttattttgcttcatatgatctgctgttaaatctttatttaaattccaaaactctgtttcgccttctttaatttgtgaaagtttaacaagctgttttgttgagacatgttcgttacctgtgatggttaaagaagatatcttgctgataggtgtctgcaaataaacaataattaaaaccatgataaaaaacagtagtataaaagagatcagtctccgattcgctttttgcttcctttgttctttaattttaggaattcgctcttctatattgacgatcttttcattttcatgatcaggccgcatatatactcttcacctcattcaaagctgcttgtccacacctttgggtcatcattttgatgagaaaacaaacggcatgaaagaatgccgtttgttttcctctgatgtcatcattcataaaaactacctattaattttcttcaccgataatttctacttctgtatgcatctctacgttgtagtcttctttaattttcttttggatgaactgaattaagtccagcacgtcttgagcagtggctccaccagcattgacaataaagttgccgtgcatatcagaaattctagctccgccgatttggtatccttttaaattcgctttttctacaagctgtcctgcatattcaggcagcggatttcgaaaaatactgccagcacacggccgattataaggctgagtttctttgcgataatctttattttgctgcatcttctttgtgattttctcgcggtcatcctgcttaagcttaaacacagcttctagaacaatgccaggtcgttccttttgtaggactgatgtccgatagctaaaattcatttgttcatttgtaagccactcaatgcttccatcttcaaataagattctagctttcacaagaatcttactgatatcagatccatgtgcacctgcgttcatataaacagctccgccaatagatcccggaataccagctgcgaattccagtcctgaaagaccttgtttactaagtgatgttgcgagccttacgacagagtagccgccgccgactgtaatttcttcatcatttacagttaggtgatccagtccagcacccagctttaggacaactcctcgaattcctttatcgagtacaagtaaattcgaccctcttccaataaccgtccaattcgtatggtgttttttcacatgatccatgatcgttttcactgcatcgatatcttttgggatgatcaaaagatctgctggtccgcctattttcattgttgtatgattcgcaagcggctcattttcaagtactttaccaacttgcgcttctaataattcattcttcaagttctccatattaccctccgccttacctaatatcattccatcatgtagtcgtaatttcttttaacacattatataaacgtgtagccgcatctggtactcctagttctttcgttaaacggctcatttgattgagtttttcttcattaccagcaatttcatcaatggcatgaagcagacgatcccctgaaagctctgattctcttaaaacaatcgcagcctcatgtttttcaagtgatcttgcattgatttcctgatgatttgccgtcacgtatgggctcggaataaaaatggttgggattccaagagccgttacttcagcaattgttgtagctcctgctcttgcaacaatcacatcgatcgatttcaggtactctggcatttgatgcaagaaaggttttgtgatcatgttaggtgctgcacctttttcctttagttcattcaacactttttcataatgaacctcacctgtgatatataaaagctggtagtttttagcctttaaatcatcttgcatttcgatcactgctctattgataggagcagcacctcgactccctccgaaaataagaaccgtttttttcttttcatcgagcccgaattctttaagagatttcccctcttttatagagacgacttcagaggctctagggtttcccgtaaatacaaccttttcagaaggaaaatgtgcctttgcttcatcaaagcatatggctaccctattaacatatctcgctaggaacttatttgtaataccaggcaggctgttttgttcgtgtataatagttgggatcttcagcttagaagccgcataaaccacaggcccacacacataaccgcctgttccaataaccgcatcaggcttgaattcttttaagtaagatttgcttttttgaacgcctttcaaaaatctcatcaccgttttgacgttatcaaaggaaagctttcgtttaaaacctgaaatttctatcgccttgaaagggatattttctctttctacaattttcttttcaagtccattttcagtaccgatatataaaaattccacatcaggatgtagtcttttcacttctttaataaaggctaaggccggataaatatgaccgcctgttccgcctccactgattactatacgcattataccatttcccctcattttttttctgctctgaacaaagtataaaccctgttttaaacaacagggctccattaaaacctgtaaagaagagtcaaaatacacgttttctaaacaaaaactgtcattttcactcttcaaatcatttttttatacttttgcaaaataaatgtcaacatggtttcattagcttcagcacgctaatatcttgcgtacctgcttacattcagaagtacaccaatcgccatcagcattaatgtcaatgatgagccgccataactaaggaatgggagcgtgatacctgtcacaggaataagtccagtgacaactgcgatgttaatcattacttgaatggcaaccattgaaataataccaactgctaggaaactcccatataagtctggagctccaagtgctattcgtatgcctctccataatagaacactaaagaggagcaaaatgagtgatccccctataaagccaagctcttcagacaatatcgcaaagataaagtccgtttggggctcaggtaaatagaagaatttttgtctactttgaccaagtcccattccgaacagaccacctggaccaacagcgtataaggattgaataatttgaaacccactgcctagtggatcttcccaaggatttaaataagatgtaattcgttttattcggtagggtgctgataagacaagtgcagcaaacccgctgagccctataaggccgagaaatataaagtgagcaattctcgcacctgaaacaaatatcataataatacaggttccaaccattaccgttcctgttcccagatccggttgaagcataatgatggcaaatgcagaaaatacaatgcctaaagctggggcaaaacctttgcgaaaggatgtgatatttttttgtttttcagataagaattttgcaagaaacgcaatcatcgcaagcttcataaattcagagggctgaatactaaacgcaccgacaccgatccagcttcttgatccatttctctccatcccgatgccaggaataagtacaagcagcaaaaggagaaaacaaacagcaatcaatatctttgaccaagtccgccacgtccaataatcgactcgcataatgaaaaacattgcgataactccgattccggcaaacaaaagctgtctttttgcaaaataaaacgaatcatcaaatttatacgatgcccacacagcactagcgctgtacaccataattaaaccaatcgtcaataaaagtaacgtaatgacaacaagcaaaaaatccggagaagttttcttattcgtcaagagaccgacaccccaagcataatttcatttgggctgtcagtcatatgagagacaagcccttatttaagcatatgcacggcgtttacaaacatgtctccacgttcttcaaatgttttatgttgatcccagcttgcacaagctggagataataaaatcacgtcttcttcttcagatatgttaaacgccgcaggtactgcttgttcaacattatcgacatgttttacgtgatgtattccaagctcttcaccaagcttcacaaacttaggtgcagtctcaccaaatgtgataattccttttacatgtttcataaaaggtttcaactcatcaaattcattacctcgatcaagtccacctgctaataaaatagtcggttgttcgaaggctgacaatgctttacttgttgccaaaatattagttgctttactatcgttataaaatttacgactctgaattgtatctacaaattgaagacgatgcttcactccaccaaatgtcgtgagaacgtgaacgattgcttcatttgagcagcctgcattttttacaacacaaatagctgccagaatgttttcttgattatgctcaccaggaaggacaacatcttttacatcaatgatatgttcattcatgtagtaaattgcaccatgttgaataaacgcaccatgttttactggctctttcactgagaaaaacactttttttgcttttgaaccttctgctagttttacaacggaaggatcatctaggttaattacagcgatgtcatcttcctgttgatgtgcgaatactttctgctttgctttttcatattcatcacgagtgtggtgataatctaaatgtgcatcaaaaatatttaatattaagctgattttaggtctaaattcaactgttcccattaactgaaaagaagagagttctgttacgatccactcatcgccagctgcatttgcagcgacttcacaagcaactgttccaatattacccgccactaatgttttttggctgtcttgtttcagcatttcataaatcaatgtcgtggtagtggtttttccattcgatccagtaatcccaataaaaggagatgaggttaaatgataagctaattctatttccgtccaaactggaatttggcggcgaagcgcttcttgaaccatcacattttcatatggaatgcctggatttttaattaaaattgtaatgtctttatcttcgaatatacgaagaggatgactgccacaaatgacatcaatccccttttcagaaagtagctgagcaggttcattttcttcaaacggtttttgatcatttaccgtcacatttactccatgttcatgaagaattgaagccgccgcatatccgcttttagcaagacctaatactagtacatgttcattttttaacatttgcatcttattcaattataaccacacctcgatgtaaattcctaaaacagcaagtaataaaccagctgtccagaaggtgacaactactctccactctgaccagccaactaactcatagtggtggtgaagcggactcatcttaaagattcttttgccggttgttttaaaggagatgacttgaagaataacggataacgtctcaacaacaaatactccaccaataatgacaagtaaaatttcaagcttcgttaaaatcgcaattgctacaatggctccgcctaatgctagagaacctgtatcccccataaatacttttgcaggatgtgcgttaaacacaaggaagccaaggacggctcctgcaacagctactgaaaagatcgctacatcatactgagattgattccaagccagtatagcaaatgctccgaaagcaatagcagcggttccagataagagaccatccagtccatccgttaaattcacagcattagaacctccgacaagcatgaaaacaacaaggataaagtaagcccatcctaaatcaaagctgacgtctgttcctggaatgcgaatcgtcgttgcaaactgataataatggaaaactgcataaaagatcacagcgatcacaatttgaccgattaatttctgtttcgatgttaaaccaagatttcgtttcatcgctactttaatataatcatctaaaaatcctaataggccgtaaccaagtgtgacaaataacagtaaaaacatttctggactaatctcagaaaatttgttgatcatcacaatcgttgtaatagtaatagaaaagataatcatgatgccgcccattgtcggcgtcccagatttcttttggtgagactgcggaccttcttctctaatactttgaccaaatttaagtcttcttaaaaacggtataaaaatcggggataaaagaacactgattaaaaatcccattatgattgtaaacaatatcacctgttcaagcatcgttctttactccttccgaatttccaaagccgttttccaacaaaaaattgcattcattattatggtattcattctcgttcttcatatgttgtttttgtacaaaatgcttcatttcattacactcttttcatcattttaagatttgtttagatctaaaatagcgtcaacagcaacctttgcatcatcaaagtcatagacttgatcgccaataatttgataggtctcatgacctttacccgctattaagactgtatcgccttttttcgcattggcaatggcaaaaaagatcgcttgtttccgattcacaaagctatgataatacgcgtctgggaccccattttccatatcttttaaaatggctgaaggatcttcgcttcttgggttgtctgatgtaaatacaggttcatctgcatatttcacagcgatttgagccatttgaggacgctttgttttatcacgatcgccaccgcagccaatcacacagaaaattttcccctctgttaattctctacacgttgtgaggacattctctaaactgtcaggtgtatgcgcgtaatcgacgatgaccgggaaatcttgatcgcagtttacaagttcaaatctgcctttgactccttccagctcttcaatcgcactcacgatcgtctcaaatgttaagccagatacgatgccaactgatacagctgcaaggatattatacacattgaactttccgacgagggcaaccgtcacttttttggtgccgattggagtgaccagatcaaactgagttcccttcggcatgatttgaatattttttgccatgacatccgctttttgctctaaggcatacgtcatgacttcagcagctgtgactttttcaaaataactcgaagcctcatcatctgcatttaaaatcgcatgcttcggtttattgtgatgaaaggcacttccaagctgagaaaacagcaagcttttcgcatgtttatattcttccattgtgttgtggtagtcaagatggtcctgcgtaaggtttgtgaaaacagcaatatcataatcacatccatgtactctgccaagatggagtgcatgtgatgatacttccatgatggctgtgtctacatcttgatcaagcatctgtttaaacgttttctgaagtgtgacactttcaggtgtggtgtttttcacgtcgagaatgtcatcattcaccttcatatacatcgtaccgattaagcctgttttcttctcggcttttctcatcatttgttcgatcatgtgtgttgttgaggtttttccatttgtgcctgtgatccctatgagattcagcttatgagtgggctgttcataaaacgcatcagctattcttgctagtgctctttgagagtgtttcacaataatgactggtacacctgttatgttaagagggtgttctgctacaatggctacagccccacttttcaccgctttttcagcataatcgtgtccatctactgtatagccttttatacagacaaaaaggcttccctctttcacctctcttgaatccatttcaatggaagtgatatcaggattttcgtttatcaattcgttgttttcaattttaaagtatgtaagcagttcttgtaatttcattttcatatcaaacctctcaaattcgttcacgtgcatgtcttgtgaaaaaaacacacagtctatattttatcgtaaaaaaaaggatacatccagcgtattccttaagtttctgttggaaaaaacacactttggactctttttttcaaactgtccttctctttcaacaaaaagaggcagccaaatgagtgcggctaccctctgttcattctttattattcatcgtttaagtataatctgatcgtggaaccttctttgacttttgtcccagcagcaggtgattgcttcactactttactgccagttcctgaggcatcgatctttaggttgatcaagagggattcaagatctgaaacagatcctcctacaagattcggtacttcaatggtttttgtgtccagccactgatacttcttttcaatttggccttttctttttttcacacccatctcaggcaggctatcccgcataatatgaccaacaattggtgcggcaacggtaccaccaaattgaatggtgccttttgggttatccacagctacatagactacaatactcgggtcatctgcaggcgcaaatccgataaacgacacaatgtggttattctccatatactttccgtcctttaccttctgtgctgttcctgtttttccgccgacccgatacccttcaacaaatgcatttcggccagttccttgggcgactacactttcaagtgcatacctgatttctttagatgtttctgctgatatcactttctttttggcaatcggcgattgctttttcacgacctcttttgtgattggatctatccattcttttgcaatataaggcgtgtaaagtgtcccgccatttactgcagctgctactgcagctacttgctgaatcggtgtaacagaaacaccttgaccaaaggcggtggtcgcctgctctacagggcctacacgatcaagcgggaacaaaattccccgcccctccccctgaaggtcaatcccagttttttggccaaatccgaaatttttgatataggaaaataatttttctttaccaagacggtctcctagctctacaaagccggggttacaggaattttgaactacttccaagaatgactgtgatccgtgtccaccttttttccagcacctgagtcttgcaccatcaactgtcacagatccgctgtcaaaaaatgaatcgcgttttaaattaactttcttctcttctaatgctgctgcaagtgtaataattttaaatgtcgaacccggctcatatgtgctccacaccggtagatttcggttgaacacttttggatcaactgattgatagtcagctggatcaaaatctggtctgcttgacattcccagcacttcaccatttttcggattcatcgcaatcgcaatcataccatctggatgatactttgcctgcgcgttgtctaattcccgctctataatagtttgtacttttgcatcaactgttaacttcatatcaagaccatctttaggcggtgtataatcatctgcttcatctggcattttctgtcccttggcatcagaataaaatttcacagagcctttttcgccttttaggtcatcgtcatagtaggcttcaagtccaagtaagccttgattatcgattccagcgaagcccagtacatgtgaaagaaagctgccaaacggataatgtctgatgctgtcttctgctacatacacaccttctaaatcaagctctcttacttcttttgctttttcatgtgatacctttctgccctcaggagaaattcgttcaattgatgttttcttcgtgacgtgcttgtacgctttctcttcagacatattcaacactgctgccaacttcttacttgtttctgcagggtctttaatttgccgaggtacaaccaaaatagatggagcacttttgttcgtcgcaagctctactccattccggtccaaaatatctcctcgttccggttcgaatggaaggtttcggctccatgaatctttagctaagcttgttagcttctcgcccataataaactgcacatatcctaatctagtatctatgatgaaaaaaatgatcaccccaaacagcagcacgaaaagcaatcgttttctcactgttacactcgacactcgcacgcccggttcactccttacatatggcttattttcatcatatgcaggcccgtccttttgtagaacgcaccgtgatattctgctggagcaaaagaaaaaacctagcaagtgatttgctaggtttaaagttaatttgggcttttaaatgtcacggtaacgactttgtctgaaatctccgctccacttttgacactttgtttcacagcatatccttgtccatttgtttctatatgcacaccggcaatcgaagcatattgaagaacttcccttctggaccagcctgtcatatcaggcatcttaatggtttttcctgctgtttttaagaagactttctggctttcagagaattcagagcccgcactcggccactggcgtttaatggagaggccgtcgccgatgacaacaggcgttaagtgtttatttttggcttctgtttctgcctgcttcacttctaaatctaagaatgaaggcatcgtttcttgtttcactttttgttcgcctgattttttatcgtctgtttttgttggtgcaatatttaaatatagcaaactatttttcatgacagggttaaagatttgagaaaccggagctgaccccgtttctgtttcagacagctgcggctgctgaacagccacatacacaagcagcttcggatcatcttttggcgccattcccataaatgaaaagacataatcgtttcttccctggaggtaaccgccggcaccgccaatttgtcccgttcctgttttcccagcaacgtcaaagcctttgatttgataaggctggcctgttccaattttcgaggaaacaacctcacctaaaatgtcacgaacttgcttcgctgtatcagatgaaatcggtttgcctgctgctgttggttcatgctgcaaaatcgttttgtttgtgttcgggtctgtaatatggtcaatgacatatggcttcatcatcgttccgccgtttgctatcgctgtggctgcttcgatttgttgaatcggtgtgatggctgatgcttgaccataagctgtcgatgctttgtcatattcatatctataattgattttgctagacgcttcgttcggcaagtcaatccctgttttgtcatagaaatgaaacttctgcaaatattgttcgtagcgtgtgaagcctagcttttcttttgccagctttgcaaaggccacatttgacgagcgaagaaccccttggtgaaagtcaattttcccccagccatttccgttgttgtggtctcgcacaaggccgccgcctactttataagtaccagattgatatttttcactgccttggtagactccttcttggatcgccgcagcaagggtgaaaatcttcatcgttgaacctggttcaaacgcatatgaaatcacatcattgttataattcgtaatgtctagttcatttaaattaaagcttggccgctgccccatcgcgagaacctttccagttttcggatcaacgactgtggcaatgattttcttcggcttatactttttggcaacctgcgtcatactttcttcaagaaacgcttgaattttctgatcgatggtcagcgtgacatttttcccgtctttcggggcgacaatgtcttctttgctattcggcaaagcccatccgcttctgtcactgttatatgtcacatagccgtctttttcttttaaaaatttgttcagtgccttctcaagtcccattgcacccgacatgtcctttgtcgcttcatttaacctggcataaccgatgaggttagaagcaaacatgccgtttggataatatcgcttcgtgtctttttcaaatgcaatccctggaagctttagcttttcaattttttccttcgttgaaaaactgatatccttccccgctttcccaaactccacttggaatgcatcttttgtattgagacgctttaaaatttcgctttcactcatatcgatgacttttgagagctcttttgccgtcttttctttatcgacgacatgcattggatgcttagggtccactgtcattttcttgctcatgaccgcaatgagcttatacacagatgtatcctcagcgatcacatttccattccggtctaaaatagatcctcttttggcttcaagtgttttcttcgattgatattgttcatttgccttggcagctaatacttgtccatcaactgttccagtaatttgaatataaataaaacgtgctaggatgataaagaaaaacagggcgaagcaaatacttgcaattgccgcgcctctgttcatcattttattctttttaggcatcgccatgttaatcgaccttcttaacatctttcgatatgcttaagcctgcttttttcgcagcttcaatgattctttctggttcactcagcaagtctttttccttttgtagctcagtgatcttcttcgattctaaagatacttgctgttctagcttctgcacttcgatattggcatgatagacagcaaaagctttagaaatgatgagaatcgagctgcacataagagccataacaaacatgacaagtaagattttttcaccaagcgtgatagaccctcttcttttaatgacaaccgattggccttgctgctctgtttgatgttgcttcacttctctttgataagccaaattactcataagaaacctcctttttatcatcatctatggtgtcgttttactttttttctgcaattcggagcttcgctgaacgggcacggttgttatgttccagctcttgttctgatgcaacgatcggttttctcgtgatcagcttgagttttggttcaagtccttctggaatcactggtagtccgtgcggaagttctggaagagaagacatttctctaaatgtacttttacaaatccggtcttcaagtgaatggaatgtaatgacagaaattctccccttcggattgagtaactctattgcttgttctagcgcttcttcaaatactttcaattcatcatttacggcaattcggatcgcttgaaacactcttttcgctggatgtccgccagttcgtcttgcaggtgccggaattccttctttgataatgtcgacaagctcacccgttgtttcaattggcgctttttttcttgcttcttcaattttgcgtgcgatttgcttgctgaacttttcttccccatatttgtagaaaatccgaactagatcttcaaatggccattcattcaccactttttttgccgacaatgcggctgattgatccattcgcatgtcaagaggtgcatcatggtgataactaaagcctctctctggtgtgtcgagctgaggagatgataccccaaggtcaaaaatcacaccgtctacgctcgtaataccttgttcattcagacgttcttttaaatatcggaagttgctttttatgaaaagaatgttcgctttaaaatctgcgagcttctctcgtgcatgatccagtgcagcatcgtcttggtcaaatccaatcaatgttcctttttctgataaatgagatagtaaatatgagctatgacctgctccgcctagcgtgcagtccacatatgtaccgtcttcttttacgtttaaaccgtcaactgtttcttttaataatactgtctcatgttgaaacatgatgttatggtcccacctttttcaaatagaaatgaatgtgtagaaagcttgctgcacaagggattattatatatcaaatccaatcatgttttcagcaatttcagcaaaagaatcttcttgctcttctgtatattgttcccagatcgacttactccacaactcaattcgatttgaaacgccgatgaccacacattctttttcgagttttgcatattggagtaggtttgatgcgatgttaatacgcccctgcttgtccagatcgcattctactgcgccagagaagaagaaccgtgtaaacgcacgtgcatcttttttcgttagcggtagtgctttgagtttctcttcgattaatttccactcactcatagggtagccaaataaacattgatcaagccctctcgtcagcacaaattgttctccgagaccgtctctaaatttagcagggatgatcatgcgcccttttgtatcaatcgtatgttggtattcacccatgaacatgataatcagagccccactttctcacccatactctccactatccaccacttctctccacaaaacttattctacactgtttctacataaaaaaaaaccctgaactagtcagggttcattaaaactttatttcaaagtttgacaatttgttgcttgttttgaaatgaaaatggcagatttttgaacgttttgaagaattctggaccatatttgtttaaaaagtacatgatattccaaattctttcctgcggggcatctagtggttttaaactattttcaattcgttcaaagtcccgaaggatatacccttccttctcttccacacgctgcgccaccttttgataaacaaattgaagctggtcttcaataaatttggcatttttatctagcagctgctcgaagtttggttcaatctccagtgcttcttgtctcatcacgccatgagcatttgctaattcacgtttggcgtgttgaaccgcttgaacaaagctgtctggaagactttgctgaaagtgcgcttctttcttttcttttactccatttgtcagcacttcttctaccgacagttctctaactggcagtttcttgtcgatatgcctttcaagaatggtcacatgcaacctcggaagaacaggcgccatctttaatttaaaatgctcaaagattcctttcagctctccccaatagttaacctcaccgtgtcctgccataaaggcaagtgtcgggagaagggtttcctgcatcaagggacgcgtcaccacattgttgctaaaccgttctgggtgctcctccacttcctgcaaaagctcttccttcgtccatgtaagccccacttctgatatagaaaaccggccgttctctttttcaatcaggaaacgttcctcatcatattcgtaaaacagattcgcctgattgtcaccagcttcaataatcggctgatatcctgctcgtttcatagcagcctgtgattcatttaagcgagtagtaaccgcatcatttgtctcgacaatgtgcttgaataacgcacgttcgagtggtttaacacctaagtcacctgaattaagtaaaagcagtccatcctcttcaaagaggtcacatacaatccattcaaagaaatcagtaaacgtttgtgatttgcgtaaacatcgaagaagctgatcaagcaagtcattggtgtatgcagattcttcatacgttgaaaacacatcacggagccatgtctcggttttttcttgatcaagcgggattcttttcgcagccgcttttttgacgttatgtaatgacagcttttgtttcactggccctttttcgccagatgtgtacacaaaattaatttcatctacgtcatgatcctcaccggctacccaaaagaccggaatcactgggacgccaagctctgtttctttttcttttgcaaactgaatgatggatatgattttatgtatggtataaagcggtcctgttaatagaccagcctgctgtcctccgaccaccatgacactccgttcatcacggatcttttcaatgttctggcgcatcgctgccgattcaaactttgcgtggtatgcgctcatataatccgctaaagcctcgcgcgggaagctcatttccatgagatcgtcgtatctctttttccatgtgtgctcagaatgtatatcataatcaaaaaaagtcgtcatctcttttttttcttctatataatcacgtatgaataaattctgacttcggatggaaagttcagtcaattgcatgtttagaacttcctttcttcaataaatagttagtttcccgaaaaaagtatagcatgtaaatgagctcactcaaaagattttgtttgctttttttccaatacttccaagcttcgatcaaagaaagtgagatgtggcgccgcaacgccgtgagcttgagccttttttaaaagataaccaaggatggcttttctttcggtttggcggcctttcactatatcttgaagcatcgaggactgattcttagcggttttctcacaaatagaaactacataaggccagagccgctttttttcagacaagcccaagatggaaactgcttcttcaaatgcacatttcatcatgtgttcatatgaggagtttgcgattaattccccgttcctcacatgcagcaaagccgtgagcggattgatacagacattgacaagcagtttttcctccagcacctttatccattcatccgtatagatcatctgaaaatgagatgatgtctcattcaatgcattttttatatctgctgcttcttcatgctgatatgccccccacttgatgacaccgatacctgtatggttcacttcatgatctgacatcttcatagctccgtgctctaccacacctatgtataatgagtgtcctgttttccaattctccaaatctaataagtgagccattccgttctgtaaaaataagatacgatgaggaggtaatgtcgatagttcacgcagcacatcttgcaaatgatgatatttcactgtcacgatgagcaaatcaaattctcctgttattcctgtctgtgcatgaacagttgcctggcatgtatctccttttcctgttcgctcaatgccgaatgctcgaatctcttctgcctgttcgtttcttcttgtaaagactgtgacgtcatgatgctgcgttaaataactagcacaaagcagaccaatcgcaccgccaccaatgattccaatgttcaacttccgcacatcccttttttgtttacttcatgatatcaactattttaacaggttcatgtcgtgatgcaaaaagcagatggcgcgccatgattgaatttttttaatttaaaaactataataataagtgtgaaaactttttgaggcggatgggatgaaaacgccttcaatgacatcactgtcgacattatgtgtgtaagggggaagatcatatggcacaagtaaaacgacttctaattaattacaaaactttagaggaatttaaacaatttaaggaatatggcatacaagaactatccatgcttgaagaccttgaaagcaatatgattgaaaatgacagcaactctccattttacgggatttattttggagataagctagtggcacgtatgagtctttatcaagtggacggctcaacaactacgtattttaaccacaaccatgattatttagagctgtggaagctggaagtgcttcctggatatcagcgcaaagggtacggcgaagcacttgttgaattcgctaaatcattcggattgccaattcggaccaatccgcgtgtcaaatctgccggtttttgggataaaatgggctttgaagcagtcaaatatgatatggagcgcgataagggtgaaaatccacttatctgggagcccgcacatattcaaaaaaatacaggtgaatccgcttaaaggctgatcacaaaacgcccctcctttctctgtgaggggcgtctctttatttagcatattcttttaagctaatattctgtttgactctttcaacaatacttatgagtgcccggtaatcttcttctgtcatttttaattgtcgcttcaagtgttcattttcttctgtaagtgacttcaattgatactgtgcatctgccagttcttcgcgtaaatgagcgggtccatcaggttctttttcaagctgctctaaaaactgaatcacttctcgaagggtcaattcagcctggtttgaagaagtcttttcttctatggttaacgcatgctgtggtaaaccagaggaatgaatacctatttttttacgcaattctttccgctgtttttttgccagctctatgcctgcctgatattgttttctaacgtatgagttccacctgaaaccacatgctgccgctgttcttgacaatgctttcccgacttcctcaaatgcggaaagctgcgttcctccatctcgaatgtgccttaaaacgacttctgctaaaagtaaatcttcatcctgtgtccatgcgtcctgccttgtaatcgtcaattgatcatcccccctgaatctgaataccacatcatatgcgcctactagagtagatagactatttgcaggggagaaacctaaaaaatagacaaataaaaaaacgtaagggaaggttccctcacgtttttttattaagcattagttgctttttacgtctttgcctttgtatgttccgcaagatttgcagacacgatgagaaattttcatttcaccgcattctgggcaagctaccataccaggtacttgtagtttgaaatgcgtacgacgcaatctttttttcattttagaagttcttctaaaaggtacagccattattcccacctccttaaagagttaagattcattattttcttctaagagcttcttcaagccttccagacgcggatcaattcggttttgatgtgcatcttccgaaatgactgcccagtcattcccttcttgtggtgcagcaccttttacgtcagtttggtcgcaaaagatttgcatcggcacttcaagaagaatttcttccttgactaaaggcgttaagtcgatgatgtcgtcttctacaatagaaacgtcttcatcttctatgtcgtctgtcttatgaagtacaaatagttctttcgttgaaatcgcaaatggataatttacatcaacaagcgttcttgaacaaggcaatgtcatttcacctgtgatggttaaatcaaatgcgacttgctttgattcgatcactccagtccctttcacctctaccggtgaaatgcgacgtatatctgaatgaaggctagtaagttcatttaagtcaaccgtctcatgaaaatcgaagctgtttttagctttttgatgtaactgataaactgtccatttcaattgtatcacctctaagagcaacaaacatgattatagctttcatcatgttatttgtcaatattttttctttacagtcctttgtgatgtcagagcgttgtttgacatcagttctcggaatgcctacactgaaaaaaatgggcttcatttttcccttatgctactgtagcatagaccatttaaccatagcaagaaaggcggaacttctattgaaagcaacaggagtcgttgtcgagtataatccatttcattatggacatgcctatcatgttcgtcaggcgaaaacacatacctcctcagatgttgccattgccgttatgagcggtcccttcctccagcgcggtgagcctgccatcgtctcaaaatgggcgcggtcaaaaatggcacttcaaaacggtgtagacattgtgtgtgagcttccatacatatacgcagtgcaaaaggcagaaacctttgcaaacggtgctgtggcgattctagatgctttaaaatgccgctccctttttttcggcagcgaggatggtgacatcaaagcatttgagcgaacagctcgtgcttggcatgagaaaaaagaagaaattgactttttcacaaaagaaaaggtgaaagaaggccttagttatccagcagctgctgctgctgcgtttcaagaggtgattgatcctaagcacttactggatctgtctcggcccaataacattttaggtttccattatgtcaaagccatcatggagcgatcccctcacatgcagccctttacctctcaaaggatttcatctggttatcatgatgaagaactacctaaaaatcagaaaatcgcaagcgcaacaagtatacgaaaagccttaaaagatcatggtgcatttgaaacagtcgccccttatctcccaaatgctacgctcaagcaattacatgactatcattcttcatatggtcttctacatactcaagaagcctactttagcttcttaaaacacgtctttcacacaatggatacggcagaactagaaggcatctatgaaattgaagaaggcatcgaacaccgcatgcaaaaagcgattacacatgcgtcctcctacgaggaatatctatcacttgtgaaaacaaaacgctatacgtggacaaggctgcagcggatgaatacacatctcttaatgagggtgaaaaagaatgccatgcatgagctgctgaaagagaaaaaagtaccttatattcggttacttggtatgtcaaagaaagggcagcaatacttatctcttgtgaaaaaagaattggacgtgccgctcgtcagtaaactgtctgccttttcacatcccgctcttgatcttgatatacgcgcatcccgcgttttcagcctgcccgttagtgaaccaatgcaaacgaacttaacggaagcggaatttaaaacctcaccgatccgatatgatgaagagactggtctcttccagtcttaacaaaaagagcagcctttacgaaggctgctccatatcgttgacaaagggctaaaatgatctttattttagtcctttgtcttcttttcagcatgatagaaaacctttgaagtctaggaaggacgagtaccggagcggagcgaatttgacattcgcgagcaccggcacgcagtcctgacaaagaatgcaagggtttgtctacatgctgagagcagcctttatgaaggctgctcttttttgattaagatgctttctcttttaatttgtttaaatagttcagcgcatcttgcattgtatctacaggcacaattttcatatcacttttaatatcttttgctgttttgacagcatttcggtagtctgagtttggatcacctttatcgttcggtgcaaagaatatatcttttccggctttatctgccgccacgaccttttgatcgattccgccaattggaccgaccgttccatcggcatcaatcgttcccgtccctgcaatcgcgtagccatgtgtttcgtcttcttttgtcagctggttataaatttcaagtgacatcataagacccgctgacggtccgccgatattttcaatatccaccttaatggacggtgagactttcacatttcggtctgtaaataatgatacgccaattccaactcgattcggctcttctttaaatggttttaacgtcactttctccgtaatgtctttgccatttcgttcaaggataaaacggacaggtgtacctgcttttttgctgctgatatacgaaaccattttatcagcagaatcataggtcttgccatcaacgcttttgattcggtcgcccacttcaatctttccgtaagcaggcattcctttcatcacgtagcttgcatatacgccgttaaacgtataatctactttttttcctgcttttgtatatgctgcaatcatggcattttcttgagagcttttcatcagctgaagctgccttttcatataatcttgatccgactccccgtccgctttcatattttcttctgggacgatttcgtcatatttattcattttcgcaagcaaatacgtatacggattggctggacctactttaattgtcataagagagaagctgcccttctcgtcatatccgccgtctacttgaatgtggggagcaatctcggttgcatcacccggctttgtcacgtaatatggcagtttgacaaaggttaaaccacataatacaaggataacgacaaaaaagctgagccagcgaatattcaattttttcattcgattaacactcccatttatcaatgacatctttcagtttacctgttagttgatctgcggcgagctcacctgcttcaatcatctcctgcacctgcgtgaacgcgctcgagctaaatgtttcaagcctcggccgaatcatgacatcagcgtgaatggtttgatgacggaccaattcattttgaaggatgtccaaactttgcataatgacatccgataatctcgtcgccttttctgtttttttcacccttgatacatcagaggcgataatgaggtctgcacccatatcttttaaaacagacacaggaatgcggtccaccaccgctccatccactagctgtctgccgcccatttcatgaggaacaaacacgcctggaatgctgatgcttgctctgactgcttgtgagacagacccttttttaaacacgaccttctcccctgtctcgaggtcacaggcaaccactgcaaggggcattcttaattcttcgaattttttcccatatgtaaacgtgtgaatcagctgcaaaattcgatttccttttaaaagaccgatttttggcagtgtatagtcagcataatactttcttctgaagacaagtgcaagttttttcattttttctacgtcttgtcctgccgcataaaagctcccaacaagtgcgccaatactgctgccagcgatcatatctacctgaataccttgtttctcaagactagataaaacgccgatatgtgccattcccctcgcacccccagagcctaacgcaagcccgatgactggtcgcttcatgaaaatccaccctcctcttttctatgcatatatacgaatctattggtctaaacatgccccttctgctcgtatagtaatagaagacaggctcggctagtttctttcttttttgatcacgagctcgccaatagatcataacggcaaggggcgaaatctccatgaaaaaatggaacactctgttcatcgctgctttttttatctttttaacagccactgtgattacacatccacaagcctctttgcaagcatctaaaaatggacttgcaatgtggtgggaggttgtatttccatcattgcttcctttttttattttgtccgagctattaattagtttcgggattgtcagatttgtcggggtattattagagccatttatgcgtcccatctttcgagtgcctggtgtaggcgggtttgtcctagcgatgggaatggcatcaggctttccttctggtgcgaaattgaccacaagactcagacaggaaggacaactgacacaaatcgaagcagagcgcctcgtttcttttacaaattcatcgaacccattgtttatttttggtgcggtggctgttggtttttttcatcatccagctttaggaattgttttggcctgcgcacattatttagggaatctcgctgttggtgtgacgatgcggggatataaagcgcggcaagatgcacatctgagaagcggtaagcgatttttattcccaccgtttcaagaggcattcagtgctcttcatacagcaagactcgcagagaaaagaccgctcggccaaattttaagtgatgcggtcatgtcatcagtccaaacactctttatgattggcggctttattatcttattttctgtttttagcaaaatgttatcagttgttcatgtgacggatctcttatccatagggatcggatatatgctgcaaacgatgcatcttccgccagaattagatcttgcgatgattgccggtttatttgaaatcacgttaggaagtcagctgacagggtcacaggaagtcacccttcttgctaaaacgattgtcgtcagctttatattaggattcagcgggttttctgttcaagctcaggtcgccggcattctggcggcaacagatatacgctttaaaccattcttcttcgctcgtttgctccacgggatttatgcagctatttttgcctttttattgttcaagcctctttatatctctcgatctgacatggctcttccagcaggtgcctttgaagcaagccagcaggtcgtcatgtacagcagtgtgctttggaatcagcttgtgacagccggccctttgatcacgctatgcagcttgatcttgtacacggcgctatactatcagaaattaaaaaaaggatgagtgcacggtgcactcatcctttaaatttttctatcagcgcttcttctacctcttttggcacaaggtctttgactgaaccatcatatttcgctacttctttgacaatgcttgagcttaagaaggaatattgattgttggtcatcatgaaaaatgtttcaatgtcatcgtttaacactttattcattgatgtgccttgcatttcatattcaaagtctgtcacagctcttaatccgcgtaaaatgactttggcttctttttgtttcgcataatcaacaagcagaccgtgaaaggattcaactttgatatttggcagatccttcgtcgcttggcgaataagctcacaccgttcttcaacggtaaataacggtttcttggatgagttatttagtacacatacatacacttcatcaaagatctttgcacctcttttgatgatatccaaatggcccaatgtgactggatcgaagctacccggacaaacggctatgttccccatgctttaatttccccgctttctatagatcgtaataccagtcaacccgtacagttcctgtcttgatatgtaaagctgtccagcttcctctggcagtgtgacgtccttatcatgctcacacacgatcactccgtcatctgttaataacgcatgctcgtcaatcatgtcaagaagtgctttcagctgttgatctttataaggcggatcaagaaagatcgcttgaaaggattcctctcgtttcacaacggcagcgagtgcacgctttgcctcatttcgaaacacttcactttgatcaatcagctccaattgattgaggtttccttttatcgtttgaatcgccttcatatctcgatcaacgaatatgcaatgatcgaatcctctagaaagcgcttcaatccctaaaccaccgcttcccgcaaataaatcaagcgcccatccgccatcaaaatatgggccgatcatattaaatatcgattcttttactttatctgtcgtcggtcttgttgattgacctggtaccgctttaagtgtgcggccttttctcgttccagagatgactctcatttttccaccactttttctgcttgcttctattggttattgtgtatgacaaaaaatccaacattatcttaccacaacactccgcaagggacaatgcgcggactttcattcattttctatgtatagatcaaggaaagcggggtcatactacttataacagcatctgatgtggtgctgttgccaaccgcggagaagacttacgtttccccataagttcttcctccggtttctcctctccctttgccttctccttaatgaatcattaagaatagaaggaccccgcgggtgatgccgcgggggtttttttgtgtctttaaaagcccactttataatcatactcttttgctttgtccaatttggattcgtactctaatttaataaaaggtttatatgaaggttcaacacgcttcacaaatggcaatgagctgagcttagccatatggcgctcgagatcattcatatcacaatagatcactgcatatttcattttccttgaaatatagtgaacatttccaaattttcttagcgcctttgactgctttaacgaatgcagccaaacgaccatcccttgacgtttggtttccatcttttcacctgccgctttttcaattcttttcagttattatgtaaaagacgagacattcaagtctcgtcaagatactttacagccacagctgccaccagatccacagccaccgccgcatgatgatagaccatcaaaatatgggttccctgttggaactttgatatatgctgatacagcttgaccgatttcaatactaatctcatctaagatggattgaatcgctgtttctgcttttttgaaatcaaccactgtatcgtgaagatctaactttcttttgacctcacgcatttcctttgagatcgttctatagtccggatggtatttgccgaaccgctgcacatcctcatattgctcttttacttttgtaaaatgggcaataatttgttgggcttcttcgtcttgctggagacgcttaaagcagttgcggtaatgttcagcctcctccgactgaagaatcatggcagccaattgatttgcttcctcttggagctccacagattcgattgtcgcatacataaatgttgcacctccaattcatagtttaccacgaaacctatggatcagaaaatgcttttacgtcacaaatacatcccatgtctctcttttctgcctatattctggatgacgagaattgagcacaacggtgattttatgttttccttttgaaagatgcttgaccacaaatgcagcagtatactcattgcctgcacgttttccgtctacatacactgtaaaatatcccgccttctcatctttttttagtcgcgtagactcaagatgaaaatcttgaagtgtactttctatatagactgacgacccctgcactttgtatttaaaaaagccttgctgcttcatttcactttcggcttgttgcatcactggtacagctggatcttgcttcgtgatttgcttcttttcatgttgactttgacacccggtgacaagaaaaagcaatgcgcacattgacagcatccatttcatcatctgattctcctttcatctacttttataggatgctcaggaaatagacatcttaatcaactcaaaaaagcctcacccggctccattttgattgcgcattgcttggaacatttgaatcatcatttcagccatttggacactgttactcaactgactcacacgatgaggaatggttttttcgtaaaaattcattttatctaattcaaaggacgatagcttatcaggatgtcgagtcagctgtctgtaccagagaggacgctgtctgatgaatttgattcgttcctcttcggccatgacaaactcctgtacttctttccgcaccaaaagcatcccctttcaattaatctttcctgaaggagaatgggtgctgactgcctccagatgaacctttcttcgagccatttgatgaaaattgtccgagtaagctttgtaaagaggaaatagactggctcattttgttgatttgttcattcatttgttcagcgtccatttttttcacagcagaaaccattttagacataaaatctgcttttccagattcacttggctttgaggctttttcttctttcacgtcctcagattgcgtttgccggtaaggagaccacatctcatcttcctcaccaaacatgacccaattttcgtatacactttgccagcttttttcttgcgtttgcacttcttgaattaacttcggatggcgtctgacgaattgtttaaattcatcaatggatgtttgtttttgcttgtttgtcatatcctcaccccccatacaaatgcctactatactatatacaccatcagttattttggtgagcctcttttttgaaacaaaaaaacagctgcgatgatgcagctgttttcgtttaagatgtttttttgatgaagttttgggtgtagtatttttctttcacaccgacgccaaggtgtgagtaatctttatttaataacgcctttctatgaccttcactattgagccagccttctaccgctgcaggtccatctacataattataggcaatgttttcacctgcgagttgaaatgccacctcgcctctttctaatcggtctttcagcgtaccgtattttttagattcatgggagaaataatgattctctttcatgtcctcactatgcatgaatgccacttcagaggtttcatcatcccactttaaggtcggcagtttgtacttatgacgaataatattggtcatatcaaaaatttgtttttgactggaagcttcgatctctttccatttttcacccgatattgcctctggttctatcaattgaccacgatagacgacttcgtatggcttttgtttcacaaatgtatctgcgttaaacgccctgatacttgaaagggtgctttcaaacttatccatgtaaagctgaacatatacatcatcgtccactttcacggtgggccttgtattcatatcatcttctgagaattcaaagcggtatgaattttgttcatcctctacatgaatgtaaggtgcaatttgtgtttttttaaatacctcacttgtggcttgaccgattttaaacggttcaacattgagcccgtctcctgttgcaaacaatgtcaccactttactatcctttacccctacttgaatatagtgcttcttcgattgattgtatatccaccagtcataatcatatgcggaaggatcaatgcgatctggttctcccagctgtttaagcacttcgtttgaagattttcccataaaggacatgagcccctttttcgggatgttgatcggcttatcgctagatgtttcttcattagacaccttcggttcattgctgttttctttttctggtgaagatccatattgaataaacagaacgtacgttccagatataatcaggaggatgaggagtgttttgagcacagttttcaaataaacacctccgttaaattggcaaggtacaaaaaaagtaccttctactgtcatttaaacaaaactcgcttcatttatcaacgacaatacagcctatttaacacgaatttaaaatatgcccctcttaatgaagaaatccttgcccatgatcttgatcctgttgagagatttctgtcagggcatctcctgcgcgatcattcgataaatcttcgacggataaatctccaagagcgacaatcccagttaatgcaccgtttttcacaacaggaatgcggcggagctggtgctctgacatcagccggacaatttcttcaagcgttgcatcttcttctgctgtcagtacttccttcgtcataagcgagcctacttcctgtgagtttggctttttttctgcaatacctctgagtacaaggtcacggtctgtcacgataccaacgagctgatctccgttaaccaccggaatggccccaatgtctgcgtctctcattttgactgccgcttcatacgtattgtcatcttgctgacatgtcactactttttttgtcataatatctttgatttttttcgttttcacgttgattcctccatctgttattttctttattactgtaaccaggttataaaagaacatacccttcacagttgaaagtttaacgctttcatactatgattgtcagtaaagggaatttttataaggaggggttttgggtgaagtttgaaggtacggggattgaaaaggtagcagctgacttaaataaattagatttcatcatggaaagtgaaggatttgtacgagccgatcaatgggattatgagcgtgtgacgtacgacagaaagtataacatggtagagggaaccttttatttacggatttccggctacgccaccgaaggagatgttggttcaaaaagagcacacatacagcttctcacacctttactcggaaaacattattatccgcacggtgttgaatatggcgaagacgaagatttccctaagtctctcatccaatcaagcaaaaaaacgcttgaacagctgaaagaaaaactagaagcaatgacagcagaagcataaacgaaagcacagccatatggctgtgcttttttcattcatatttcggaatcagcgcatctggtacggcatctttcgctctttcttttcttgcccagtcaaagaagacaacagcaaggattgagccgtacacaatctcctgaattattttcatcaaaatcgcgcctagctgctggtcttctagcagcggcaaggtatggaacatttcaggacctgtgagcgcaagacctgccagcgtatcacttggtacgcagagatgcagcgcctgtatccaagcaccagcatcagaataggttgcatagatcggtgtctcactaaacataatgagtgcacatgcaggagtcattaatatcccgtctgccataatataaccaagctttaaaatgcctgtaatctgaggctgactttggactttatgaacgagcggccaccacatgaaaaaggcagcaataaaaatgaccactgtcatcagcgcatgataaaacggatctgttttcacaaaatcaaacacaagcgggatatggtacatcgaaaacaaaccgttaaaccccagcaatgcaattaaaggcttggtaaacaaacgaaacatctgctgaatgcctggtgtttggatgattcgctcccaaatggccgcaggtaatcctgtaataaggagaggcggaatgactaaatagagcaccgccatttgcgccatatgcgcactaaacataatatgccccattaaatcaattgggcttccttttacggcgtataacagaacaagccccgtcagaaacaacgttttctcttttaccgtcgcacgatgcttcccctttgtcacaagaagcagataaagagcagctgctatgacaatactagtcaaatagtaagggctccataatgcccgaaatccgaatatctctaagttctccattgctgcgcctccttcaagggcaaagcgggcttaccaccatataatggtcaaaaaggctaatacggtaataaacgcgacaaacacacctgagtaaagaaacaatgcgggtgtttcatgccctttttggttcatgtgcataaaataataaagctgaaaagccacctgaataacggcaagcagtaaaataaatggtactgcgaaccagtttccaacatcttcagaagcgattgttaaaaaggcaacaaaggttaatccaatcatcaagccgaaagaaatgagctgatgcttcatttcttcggcatttttctttttacggtatacaagatcgactttagactgatttgtgtttttatttcccattcttatcccaccattcccattaaatatacaacggtaaagatgaagacccacacaacatcaatgaagtgccaatacagacttgccacataatattttggcgcattgtataaatcgagtccgcgtctcatatttcgaatcataagagcggtaatccagcaaagtccgaaggcgacgtgagccccgtgagttcctacaagtgtatagaaggaggaaccaagagctgagctggtaatggtaaaatcatacgcatgcacataatgatagaactcataaatctcaacccctagaaatgaagcacctaatagcacagtcacaccaagccaaagctgcatctttttaaaggcaaagtttttcatatgatacattgcatacacactcgttaaactgctcgtcagtagaagcatcgtggcaataaagacaagtgtgagatcaaacatatcagttgtttttgctccgcctgcattagagtttttcagtgccaaatatgtggcaaagagcgatgcaaacagaacagtttctcccccaagaaacaaccagaacccgacgaacttattctttccttctaaagtggctttctcaggagaagccggaaaagtttctgctgtcattttttgtggttccattatgctttcacccctttatcatcgtcatcggtcagatcttctttgtgaatatggtacccatgatcgtctttaagagagcgaaccagcatggttgcaaatgtaatgccaagaccaatgagaatcactggaagcccccagctgtgctcttgacgatacatgaagccaaacgctgacacaaatagaccgaatgagataatgacaggtaagatggaattattcggcatgtgaatatcatcgagcggttcagatgctgtcattccttttttaccatccattttttcaatccataatggatctagtcctctgacaagtggcagctgtttaaagttatattctggcggaggtgaagacactgcccattcaagcgttcttccgtctccccaaggatcgcccgatacacgctcccctttcgctgtcgtccagatgacgttaatcagcaggatgacaacagctacaaacataaacagcgccccaatcgtactgaccaagttcccaaggtctaacccctgacctgggagaaatgtaaagactcggcgcggcatgccccaaagaccgaggaaatgctgaataaagaaggttaaatggaaaccgatgaaaaatagcacaaagctaattttcccaagcttctcatttagtatttttccaaacatcttcggccaccagtaatgcacaccagctaaaataccgaataccaccccgccgataatgacgtagtggaaatgcgccacaacaaagtacgtatcatggaactgataatctgctgcagctgctgcaagcatgacgccggttaccccgccaagtaaaaatgacggtataaaggcaacggaatacagcatcggcgttgtaaacttcacattaccgccccatatggtgagcagccagttaaatactttaattcctgtcggcaccgcaatcgccattgtggctacagcaaagatggcattggcaatcggaccaagtcctgttgtgaacatgtgatgcgcccacaccatgaatccaaggaaaccaatcaatacagtcgcaaacaccatcgacgaatagccaaacagcctttttcttgcaaacactggaatgatttcagaaaatattccgaatgctggcaggattaagatataaacttctgggtgtccgaaaatccagaacaaatgctcccagatgattgtattaccgccgagctctggattgaaaaagctcgtatcaaacattctatcaagcatcagcattgcaagccctgctgtaagcggcgggaatgcgaataaaatcagtgctgaagcgacaaatgtcgtccatgtaaagagcggcattctcatatacgtcataccaggcgttctcatattaataatcgttgcaagaaagttgattccggcaattagcgtaccaatacccgctatctgcaaccctaaaatatagaaatccatgccgtgtccttctgaattcagcgtgagtgaagcgtatgcagtccaacctgcatcaggtgccccgcccataaaccatccaaggtttaagaaaattcctccgaaaaagaacagccaaaaaccaagtgaattcacaaacggaaatgctacgtcacgtgcaccaatttgaataggtacaaccgcattcattaatgcaaataaaagcggcatcgctgcaaggaaaatcatcgttgttccgtgcatcgtcatgacttcattgtaaaaccctgcacttacaaaatcattttcagggatggctagctgaatacggattatcatcgcttccaggccgccaattaaaaagaaaaatccccctgccactaaatatagtacggcaatttttttgtggtcaaccgtcgtcaagtaatcccataagacagcgccaaacccccgctttttagctattgtactcaccatgaaatccccctcttatctcccatttgccccttttcatatagatgtctattttaactttacacagactgtgtctgacagatggctacttcttggttgtagagacatattcgggagctcttaacaaaaacttcacatcgattacataccctcttgcccatttgcattcgaatttactggattttaagttcttttaaatactcataaagtgcatctgcttctgagtcatttaatttagggtacgtccctgtcattttatttcctggtttaaagctctctggatctttcagccatgctttcacgttttctttgttcatgtctttaattccagctacttttgttcgctctccgaaggttgcaaggtttggtgctgtccttgccgcttccggccgttcgtccccaggctctactgcgtgacagctcaagcagtttttctctttaaataatttttcaccttcaagggcgagatcttttgtggatgtaggcttcttgtaatcagccatttttttcgtccatcctaaaaactcatcttgagaaagcgttttaactttaaagtccattaaagcatgtgaaggaccgcaaagctccgcacatttcccgtagaaatattcccctgcatctttcgttcgttttgaatcaaaggttaaataaaacttgttttcgttgtctgtgtttgtatcaattttaccgccagccgatggaacccagaaagagtgtttcacatcagatgctttcaatttaaagtagaccttttgatctgttggtacaatcaattcctgacttgtgacaatcccataatcagggtattcgaattcccaccaatataaactggctcttacattgacaacaagtgtcttttcaggatctcgttttttcttatccatagcgcttgtatccccaagctcaagcgtgtatgccacaacaggcacaacgagaataatgaggagaagaatcggaatcgctgtccacgtaatttctagattacggtttccttccacctgctttggaatcgtatcttctcccactttagaacgtttgaatttaatgatgacgtaaaagaaaatgatcgatacaacaatgacgacaagaaccataatgagtgtactcagtaccgttaggaagaattgtttatctgctacttccccaactggtttgagtgttgataagtatggttcaccacagcccgccaaaacgagcgtcaataagagaaacagtgaataaacacgccattttcttatcataatttgtcccaaccccttttgcttgatctcctttgcctttcgctttttacctcttatttataaaatcacttttcacccatccataacccccgcctcttataaaagcacttacatttcctcttttcataaaaaaatgatgtttttactcaaaataccatctatgtataaacagaaagccgcctaaatagaactgaatatcaggcggctttcatagttgttagaaaatgttgtgttataagatatagccttgttttgatgtgatcaaagtgtattttactctagaatagtgtaataataatcatcgcaacgaaaaagatggttaagtaatttaatgaataaacgaacatgagcgttgaccacttcatgacgtctttcattttaaagcccataaggccaatgacaagccatccaatattcagcaatgtgccaagtgcgacaatcggccatcctaatccacctaagaaaaatggaagcgggagaagacatgctgtccaaatgatgatttggcgtttcgtgacttcaaagccataaacgactggcagcattggaatacctgccttacggtaatcttccgttttcttaatcgcaagtgacaggaagtgcgggatctgccaaatgaacaaaatcataaacaaaacccaagccgttgtgtcgattgtacctgtgacagctgtccagccgattaatggcggcactgcaccagacacacttccaataacggtattgatggtgtaatgacgtttagaccacatggtgtaaagaaccgcataagtaaagactccaataaatccaatcactgctgatgttatggttgtcattagaagcatgatgagtccaagtacaacaagcaaaataccaaatgcatacgcttgccccggctgaatcttacctgtaaccgtcggtcttgtttttgttctttccattaatatatcaatatcacggtcaaacgcattattaatggcgcatgaaccggcaataataagagaagaaccaatcattgttaacagcacaatatctagattcccaaggaaactcatccctgtaaaataaaaagcaagccacattccagtaaatgtcgtaatgaaattggaattgacgatgcccattttaatcagagcaagaaaatctttccaagctgttgtttcttctatttgtccatgaatagctgcttccgcggctgttttggaatttgccaatgtgtataacctcccttgcccaaaccttcaaacgaactatgaaacgtaaattcgttacaactctatcatacaagataaacagctgtaaaaaaacatcctattaaataataaacgacaatctcgaagttatttgtgaacttttcgtgaatttattaggatttatctgtgtttcagaaggcggtgcaaaatgaaatattctctcctctatttctatcagactgtgaaagaaagatcaagcactctaaatctgtaaactttgtgaactaacatatcatttttttgtgaactttggtcattatgaattgcaacagaacacgcatttggcttaaacttgagagcatgtgaggtttttcatttagatcagaagttttttagagaaggtgaaataatttgatgaaatttgctttaaggttattgagcgtgatcacaacgtttgtgatgctgatcgttttgattggcggtgcgcttgtgacgaaaaccggctcgggtcttggctgcggcaggcagtggcccctttgccacggtcgtttcttccctgaaatgaaccctgcttccatcatcgaatggagtcaccgcatgtcaacaggggtttcaaccattcttgtcttggcactggcggtcttatgctggaaaaagattagtccagtattccgtgaaaccaaatttttggtcatcatgtcgattatattcttactgctacaagcgctgttaggggctcttgccgtcgtgtttggttccaacgcacttgtcatggctctgcacttcggtatttcactcatttcttttgcttcagtgttattgcttgcgcttcttgtattcgaggcaacccgatctgaaacaaagcttgtgaagccgcttcatatcggcaaaaaaatgcagtttcatatttatggtttgatcacctatacgtatatcgtggtgtacacgggtgcttatgtgaggcatacaaagtcaagtcttgcttgctctgtcttcccgttttgttcaaaagacggtgcacttccagcgtactttaatcagtgggtgcaaatgtctcacagagcagcagcacttcttttattcgtctggatatttgttgcgatgtttcatgccatgaaacattataaagaacagaagcagctgtattatggatggattatttcagccattcttattacacttcaagcgatttcaggtgtgatgtctgtgtattctcatctcgcacttggttacgcgctggctcattcattatttatttccggtttgtttggcgtactctgttacttctgcttacttattgcccggtttaaatatgaaagcaaagaaccattcaaataagaatttgtatcccccttccatatggaatggggatttgttttattgttgttttgcttcttcaaatagcgaaatggcttttttgcgtctttcctggtggtctaccgtcggcagcggatatgtatcacctagcacacatcccgatttcaattgctcatcaatcggcattttacttggttcatgaatccatttttcatcgacatactctagctctggtacatattttctaatatattctccgctcggatcaaatcgctttgactgagtggtcgggttgaaaatacggaagtacggcaccgcatcagttccgactgaggctgcccactgaaatcctccgatatttgacgcctcatcataatccacaagtttttttgcaaaatacgcttcgccctttctccaattaatcaaataatcctttgttaaaaatgaggctgtgaccattcgcaaacggttatgcatccagccctcctcatttaactgtctcatccctgcatcaacgagtggaaagcctgtttctcctttacaccaagcttcaaacagcgtctcatcttcattccatttcatcccttgaaacgccaaattgatttctttttctttcatctcgggataatgcgcataaatcatatgataaaaatcacgccaagccagctctttaataaaggtctctctgccctcatcttcatagagtgcttcttcatatatcgaatgaaagatcgttcgaattgaaatagtacctgtttttaagaaccgcgacagcttgctcgttccaaaaacagacggaatatcacgtttctcatggtaacgtgttaatcttttttggataaagtgatgcagcgtgctcatcgctttgtctgagccaatttgatcaaacttccttgagcagccctttatcaattctcgcagtttatcatttcctttttgtgaaagtgactcatcacaaatcgtatgcccactgctaaaaaatgatttgtcaacttttatcacaggctgcttctcttgcttacgccatgattgatagtatggggtaaacacttgataatgtgacccatctgcttttaaaatatctcgcgccccgtgaagatgtgtatcttgccacattgacacatgaatgcccttcttacctaaaaaatcggttacttgcttgtcacgcctttggccgatacccacttcatcttcattaaaaaagacggctttgatgtcatacacatccatgacctgctgaaaggcgcggaggacatcatcatggagaaggtggacatacacttgagattctctcgcttccttgacgaaatgcgccaagctttgaaagaaatgttcgttatttatatccatttccatttcagtaaaaaatggatctagatgataaagagccaataatttgtactcatgtttttttgcatatgtgatcgcttttgacaaggcgatatgatcatccaatcgcagatctcggcgaaaccaaatcacgacaatttccaactttcttcacctcactctatagtgtaatcactctcgcaggctgctgcacattttaatgcgctcaaaaaaagacacatcacgatggatgtgtctcaattattattcaggctttaaaacaatgagcagatctcccgtttgaatcggttctccatttgtcacatgtatttcatctacgaccgcagtgaatggagcttgcacagtcgtctccattttcatggcttcattgatcatcaaatgctcaccttgcgaaattttctgtcctttttccacgagcactttgatgacagtgcctggcattgatgcggcaatgtgatttggatttgaacggtccgccttcattttttcttgaacggatgatttgatgctttcatccttaatgacgacttcacgaggctgtccatttagctcaaagtaaagaactcttgtggcatttggattcggttctccaattgacacgagtttaacaatgagggtttttcctttttcgatttctacctcaatctcttcaccaagcctcatcccgtagaaaaacgttggtgtgtcaagaacagagatgtctccataactttctgctgtttggacaaattcagaaaagactttcggatataaggcatacgcaattgcgtctttctctgtcagcgtcaggtcatgagattctttaaactgctgctgaatagcttcaaagtcaactggcttcagcttttcaccaggtctaacagtgagcggctcttctccttttaaaatcagcttttgcaatttttcagggaatccgccatgcggctggcctaaatagcctttaaatagttccacaacagaatcagggaagtctaaagttgctcctttttcatagacatcttcctctgttaaatcattttgcaccatataaagtgccatgtctccgactactttagaggaaggagtcaccttcacaatatcaccaaacatgtcattcacacgtctgtacatttcttttacttcgttccagcggtcgccaagcccgacacctttcgcctgctgctgcaagttactatactgtccgccaggcatttcatgctcataaatttctgtatgaggtgaattcatgccgctttcgaattcactgtagtattttctaacagaatcccagtattgagaaaggtgttcgaccgattggacgttcatgtctggctttctttcatgcccatctaaagcatagtacaatgagcttgcacttggctgcgatgtgagtcccgccatagagctgacggccacatcgacaatgtcaacacctgcatcaattgcccttgcataggtgaacagtccatttccactcgtatcatgcgtatgaagatgaatagggattgtgagctcattttttaaagcagtgactaactcataagctgcctgcggctttaataatcccgccatatccttaatacctaaaatatgcgcaccggcagattcaagctctttcgcaagagatacatagtacttgagatcatatttcggacgcgatggattgagaatgtcccccgtataacaaatcgctgcctctgccactttgcctgattcacgaacagaatcaatggcaagtgtcatgcctttcacccagtttaagctatcgaaaatacggaacacgtcaatgcctgcttcggccgattcctttacaaatgctttaatcacattatccgcatagtttgtatatccgacagcgtttgatgatcttaaaagcatttggaacaacgtgtttggcacttcttggcgaagctcttttaatcgctgccaaggatcttcttttaagaaacggtacgcaacatcaaatgtagcaccgccccacatttccatactaaacagctctggccataaacctgctgttggctgggctactttctttaaatcatgagttctgaagcgggtcgcaagcagagactgatgcgcgtccctaaaggttgtatctgttaaaaggacgctcttttgttctttcacccaattggcaagaccctcaggtccatgcgcatctaacaattgtttagtcccagatagaatctcttgcttgagaggaagcttcggtacaacaggcttgtcaaaatgaggcttctttttctccgcaataccagggaatccattaatggtcacgttaccaatataagtcagcatcttcgttccacggtctttttgtttagggaaattaaatagctctggcgttgaatcgataaatgacgtatcgtattccccttttagaaacttctcatgctttgccacgttttcaagaaacggaatgtttgttttaatcccgcgaattctgaattcctgtaagtttcgaaccattttagcagcagcttggtcaaatgtaagcgcccatgtggacagcttgaccaatagtgaatcgtaataaggtgttatgactgcaccttgaaagctgttccctgtatcaagtcgtacaccaaatcccccgcctgaacggtaggccataattttcccagtgtctggcataaaatcatttaaaggatcttctgttgtaacccttgattgaatggcaaaaccatgtgtgaaaatatcttcttgctttggtataccgacttccttgctgtgaaggtcatgacctttcgcgacaagaatttgggtttggacgatatcgacacctgtgatcatttcagtgatcgtgtgttctacctgtacccttggattgacttcaataaaataaaactctccatttgcaacaaggaattctacagtgcctgcattgatatatgatacattccgagccagctgaacagccgcttcgcaaatgtcttcacgcagttgatctgtaagagacacacttggcgccacttcaatgaccttttgatgccgcctttgaacagagcagtcacgctcatataaatgaatgatattgccgtgattgtcaccaatcacctgcacctcaatgtgtttcggattttcaatcagtttttcaacgtatacttcgtcatttccaaaagcggcttttgcctctgacttcgcacggtcataggcttccttcagctcctctttcgttctgacaatccgcataccccggccgccgccgcctagtgaagctttaataataaacgggtaaccgtattcttcaccgaatttttcgacttctttgaccgaatcaactggtccgtcacttcctggaatgactggtattccagcttttttcgcttgttctcttgcctttactttatctccaaacatatctaaatgctgagaagttggaccgataaattgaatgccttcctcttcgcatcgtcttgcaaaatgaatattttcagataaaaatccgtaacctggatggattgcatccacatcatttcgttttgcaatttcgatgatcccctcgatatcaaggtaggcatcaatcggtttttttccttctccaactagatatgcttcatctgctttatagcgatgataagagcctgagtcttctttggaataaatggctactgtacgtaaattgagctccgtacaggccctgaagactctgatagcaatttcccctctgtttgcaactagaaccttttgaattgttctctgtgacatttctcactcctccatatcccttaaaattttatatgtactctataataaaggaagaaatgaaaactgtacacttttgttttctaaagattcaaagttttctgcaatccatttttttgaactggtggtttgctcattgattttttctttttgtaacgctctttatattcagtaaacatgctgatattcagcaatattcccatacaaccgcttagtaaaatgatagatgatcccccgtagctaataaacggaagtgtgaccccagtaatcggaatcaaacctgaaacaccgcctaaattaatgcatgtttggatcgcaatcatggaggaaattcctattgcaagcaaacttccaaatggatcttcacactttcttgcaatataaaatcctttcacgacgatgaagccaagaagagcgagtacaaaaaatactccgaaaaagccaagctcttctgaaatgattgccatgataaaatcggtgtgcggctctggaagatacccgtacttttgaacgctttctcctagacccagtccaaaaaagccgcctgatccaatggcataataggaattaatcaattgatgtccagtagctcctgcatctttaaagggatcttggaaactctcaaaacgcccgagacgattttgcgtgaaaattttatcccagaacagaataataaatggggtcacgacgaccatcacggcactaaataaggccagcagcttcgcaagtgttttcccgctaaaccctgagcataaaatcatcgcaagagcaatcatcccaatgataaaggctgtcccatagtctggctgcaaaatgataaatccgcataagatcgaaacaaccacaattggaggtgtgactcctcgtaaaatatgatcaatataatgctgctttttcgcatacacagcagcaagataaataatgacgacaatctttacaaattcagctggctgaaggctgaatgggcctactttaatccagcttcttgcgttccctgcaatatgaccgccaaagtacacatagatgagggagaatacggatagcagcagcataccgatctgaaatttcttatttgaaaacagctgatatggaacgagtgccgtaaagagcaagatgaccgctccaacgatcataaataaaagctgtttcttaaaaaaattatctggcgcggcatcgtatctaatcacagatgtaatcatacttgagctatacaccatgaccaaaccgaatgcgctaattaaaataatggcgaacaataatgagtagtcatacgattttagcattctctttaacatataatcctcttcctaacgtctgtttctactgcttgatatcctcttagctgtttttattctactacattttctccgtttgatctcgttttacctcttttatattgttcgtcattcatgaaagaatcaagtccgtttgacatgaatcaatgaaaaaaatagaggacaaaaaaactcaaacttatgttaaggaagtttgagttttcaatcactatttttttgtgaacgcatcatgaagtgcggaaagctctctctcaagtttatcgagtagtttcttaccttcatgttgatcaactaatccaagccggacagcaaaatcaatttctctcgataatccgaacatttgagtatctaaaacctcttcataaagaggacattgcggcatcgttaagttgtccatttgcacttggatcaattttaaaattttatctgcatccaattttaataaagccagtgctttttgccgatgatcgactaaaatttctgacgccaaaagtatccctccgttccccaggcgagtacctaattcttctatttatcataaagcgaaacgcccaaaattgcaagcagatttgtacagttcgcttgtaaaaataaaaagaagccttcctccattaaaagatactcatctcgtatttttcactcatcagctcaagcagcttaattccagcaatactattccctttttcatccagagcaggaccgaagataccgatcccaaaatcatatggtgcagctcccataattccgcctgagacaccgctttttgcaggaattccgatgttaatggcaaattctccgctcgcattgtacatgccgcacgtcaccataaaagttttacaaattcttgcgacatcttttgaaagaatctgcttccccgtttctggatgtctgccgtctaatgaaaaaacacaagcaacttttgccaaatccaagctgttcatcatgatggcacattgtttcgtatagacgtccatgacttcctctacgttccctctaataatatgatattgcttcatataatagcacatcgcccggttaatcatggatgtctcaaattcggaggcagctgtttccttgcagtatgtaatgcttttgtcatttgcaagctctctaatgaagctgagcaaccggctcagctgatcttgcggagtcgctcctctgattaaactcgtgactgcgagcgcccctgcattaatcattggattcagcggtttattcggactcgctgtttccagtttaatcattgaattaaacgggtcacctgttggttcttgtccaacaaattgaaagactttttttggcccttcttctgagagcacaagcgccagtgctaatacttttgaaatactttgaagggtaaatcgtttatctacatttccagctgagtggcacgtattactcacatgatacactgccacagataaatccgtctgatccgctttgccgagagcgggaatataggatgctacatgaccatctttggccactttttttgcttcttctacaaatcgttgaagctcttcattgtcgcgacatgccatgcctcatacactccctatctttcatgtatgattagtgtgtacaaggtgcagcatgtttatgaaagtgacaaagcggacgaaaacttctataatttatgttggaaaggggttgtcttgaacatgagcatcattcaaatcaaggggaacgtacagtacaagatcaccattgatccaagtgtatggatttttgatgaccgcaaatttttaatggattcattttttgaaaaaaatgcagcaagtgaagagaatcagctagatcaggagcttgaccaagagcgggtgataagagaaggtcaaactcttccacccacgttaaaaacagagaagaagtacgaaaaggaaagactcgtcacaggcagcttcgggatgaagcttggcgatatgctaaaaaatgctgagccgcttgaacatgcggatacatgcgaatttgtcacagaaacaggtactattgctgtaccactttctcaggcaatggaaagcattgctcatttcagccagcatggtaagccaatcacagaagaaggaccaatccatgtctatttcgcggatcagtccaacctcactcagccgataaaaggtgtcaaagagctgatcattacataagtcaaagggtctggactatagcaaatcagcggcaagctgtgcaagtccagacctttctcctttgacaagcttgacatgtccagatatttgctgccctttgaaccgttcgatcacatacgtaagcccattatttaagctgtctaaataaggatgatcaatctgctctggatctcccatcagcacaattttacttccctctccgactcgcgttaataatgttttcacctcgtgctttgttaaattctgcgcctcatcaatgataataaattgatcaggtatacttctcccccgaatgtacgtcaatgcttcgacttgaatagatccaattcccgccaaaatcgcatcaagctcaccaggcttttttgtattaaataaaaactctaggttgtcatagatcggctgcatccatggtctgagcttttcttccttttctcctggcaaatatccgatatctttcccaacaggcacgatggagcgtgccacgatcaactttttaaacatacctaggtcctctgtctgcattaatccggcagcaagtgcaagcaatgttttaccagtccccgcttttccaatcagtgtcacgagcggaatgtcacgtcgcaaaagcagctcaagcgccatcgtctgttggacgttttttggacgaatcccccaaatatgctcttgatcataaacgagacgctttacatgctctgccttttgatcaagcattcctaaagcagaaccaccttcatttcccttcatgatgacaaattgatgagggttgaatggtgcacttgtgacctcttttattggtaattgattttgcttataaaatgtattcaattgctcagttggaatgtagagctcatgatagccattatcgatgtcttcattttgcaaaacacggtcacttaagaagtcttctgcatgaagccctatagcatccgcttttacccgcactaacacatccttgctgaccaagataacaggcctgccatgaggttttgtttcttcctctaagcttaaatttttcgcgactgccaaaattcgattatcgtttgttttttcaataaaaatttcttgaagctcatgaaaagagcggtgattcagttcaatgcgcagcgtcccttttgactctagtgtaattttttcatgcagtttccctttcgatcttaaaccgtcaattaggcgtgagacgcgtcgggcattttgcccaacctcgtccatgtatctcttttttgagtctacttcttctaacacaacggcgggtatgacgacctcgttgtcttcaaatgaaaagattgaattcggatcctgtaataacacatttgtgtctaatacataaattttactcaggtccttcgcctcctgatcggggtttcattcatcctgtctttcccaaaacgattgttaaaatatatgttttcatgaataaagttagaaggttaattcaacaataaaataaatcatgcagtttgtgaaggagggaatacagatgcgactatttttgacattattcatgattcaagccatcattctgttgggcgcttgccagcagcaggaaaagccagaggcacttgacaagcagcaagatggacgccagcacgtagtacgggtgtcagactcgactaagaaaaagaccaatcaagcccggtcatctacagatgttgcgcagcatcttgtcaaagtgacagagcacgtagcagatgtcaatgatgcaacggcgatcgttatcggccgttatgctgttgttggtattgatgtaaaagatgatttagatagaagcaaggtagaaaacattaaatattcagttgcaaaagcactgaaaaatgatccagaaggtgcgaatgctgttgtggtcgctgatccggatacagtcagccggttaaaagagatgggtaaagaaatacaagcaggtcgtcctgtcagtgggattatggatgaactagccgccattgtcggccgcgtgattccagagatgccgagaaatgaaattgatcgccacgaaacagatccaacaaatgagccgaatgatcagctcaaacaaaacgatcaaaagcagttagacgaacagcaaaacgatcaatcaaaccatcatatgaatcagaagaaataaagagaacggcttatatctcctgtgatataagccgttttctacgctgattttaagtagctggaaaacatgctataataaatgcaataagtgaggtgaaaaggatgagagtgaagtgctcattatgtgagaagcttgaaaccattgatgatgatacactcgttgctaagcggttaagaaatcgaccgattcatacatatatgtgcgatgactgtcaggaacgtattaaagtaaagacagaagcacgcatcaagactggcagattctctctttatcaagatcctgcgacgaaagagaaaaagaagaaaaaaggaaaaaaagaacaaaagacataaaaaaagacctgacacaagttcaggtctttttttacgtattcactgttccttcttttttcgcacgatgcagcctgattttataaataatcaaaatggcagctgccacgactagaccttccgctactggcaggaagatacctagaaatgtgagaaacgtgcagccaaaaatcaaaaacaagtaaatcacgaatgcttttaaaatcggtaaacgtctagcaaagccgagcttaaaaacaataatcgctaaaacaaggatggtaccatataggagccacatccctgtttgcggattttcatcgacacgaaacagcatcgcgaaaaaggatagattttcacttacttcctgatcattcaaaaagattccctccccttacctttaagggttctatctttttaattcttcatggaattacgataatcctgctagctttttcttcttcgctgctttctcacgttcgtttttatctagaattttctttcttaaacgaattgattcaggcgtaacctcacagtattcgtcctcattcaagtactcaagagattcctcaagtgacataatacgtggttttttcatgctcaccgtttgatctttcgtcgccgaacgcacgtttgtttgttgtttcatacggcttacgttgacaacaagatcgttctcacggttatgctcaccaacaatcattccttggtatacttcaacacccggctcaacgaagatcacaccgcgctcttcaacgccttggattccgtaagcagttgctttacctgtttccattgaaacaagtactccttgacggcgtccgccgacttgaccagactgcattggctggtagctgtcaaacgtatggtttaaaataccaaaaccacgagttaatgaaagaaattcagttgtatatccgattaaaccacgtgatggcactgtaaagatcaggcgaacttgaccattaccgttattgatcatgtcaatcatttcaccttttcgtgcgcccattgattccatgatagagccagtgtgctcttctggtacatcaatttgaacgcgttcaacaggctcacatcgaacaccgtcaacttcttttacaataacttctggcttcgatacttgtaattcaaatccttcacgtctcatattctcaataagaatggataagtgaagctctccgcgtccagatacaacccaagcatcaggtgaatcagttggatcaacacgaagactaacgtctgtttgaagctgctgctctaagcgctcttcaattttacgtgatgttacgtattttccttcacggcctgcaaatgggctgttgttcacaacaaacgtcatttgaagtgtcggctcatcaatacgaaggattggcaaagcctcttggtgttcaaccggacaaaccgtttcacctacgttaatgtcttccattccagatacagcgacaagatctcctgcttttgcttcgttgatttccactcgttttaacccttggaaaccaaagatctttgtcacacggaattgtttcacactgccgtcaactttcattaaggctacttgctgtcctacttgcattgttcctctaaatacacggccgatcccaattcttccaacataatcattgtaatcaagtagtgccacttggaattgaagcggctcttcatggttatcaactgggcaagggatatggttaacaatggcttcaaacaaagattccatgttttcatcttgcttgctcgcatcgttacttgctgtaccattgattgctgatgcatagacaactgggaattcaagttgttcttctgttgcatccaattcaatgaacaagtcaattacttcatcgactacttcagccggacgagcaaagtcgcggtcaattttgttgacaactacgattggtgttaagttttgctcaagtgcttttttcagcacaaagcgtgtttgaggcatacagccttcataagcatccacaacgagaagtacaccatctaccattttcatgatacgctcaacctcaccaccgaaatcggcgtgtcctggtgtatctaaaatattaatgcgtgtatctttataatggatcgcagtatttttagctaaaatcgtaataccgcgctctcgctctaaatcatttgaatccatagctctctcagcgatattttcattcgcacggaaagtaccagcttgatggagcaattggtcaacaagcgtcgttttaccatggtcaacgtgggcaataattgcgatgttgcgaagatcttttcgaagtttcacattttcatctcctaaaataattagataactttcatattatatcacaatcccctttaaatgccgatcgtttttctgtaaacttatattaactctaaaaaaaagggatggagacaaatgaaacaaatcaaatggcttctattattatgtgcattacttgcggttgtcagtatggcgtttattgggataactcttgcagaaaaaaacgtgctgggtatttgtctaagtattgtgtttgccatgattttcatgggtacaggatttacattaaaaagaaaattaaacgtgcaatcataaaatttctcaaaagccttttacattctatatgtagaaggcttttattttaggtaaaaacaagaccaaccacctatgaaaggtcgtgtataagacagaacatatcatttagacttggcaaaagtaagccatctgaacctctccatttttcgacaataacgtttatagttctccaaattcaaacataaagttacaattttcctattcttccacaaagtttctcgtggtatgctgttcttgcaacaaaatttaacagaaaagggagagaaaagaagcatgaagaagattttgagcaaatcgctcagctctgttgtatttttcgctttagctattattcttactttcacaacagtagctcctgggcaagcaagtgctgcaactttcaaagggattccttttgagcagcagcaagtcattaaagaattattggagaaaaacgagcgtgtcatcaacattctcatcaactcatttgttgaggaagacaacaactacacatttgatgtgaaaaaagctgttgagctcggactaactgaagaagaagcggcgactgctgagaaattcttagatcgcgcagctgttctgacaatcgttttcagtgagagcgtcactaaaaacgaaaaaggaaaattggtttttgatgcagcgaaagctgttgaacttggtcttacaaaagaagaagcagctaaatttgaaaagctgtttaaatcagtgatcagaattgctgatcttgctggtgatgcacttgttttagacaaaaaaggtaatgttgtcattgattcaaaaatcgcaaaaggtattggattcagctctactgaattacttgttttcaaccaaatgctgaagaaaattcctcaagagcaattaaaatcagtctatgatgcaatccaaattgctaaagaaaaattaagctaagcatgaaaacccccatctggatcgaccagatgggggtcttttatttcagccagttaagaatggtcaactgatcatttcatatcgatagccagttgcgcttcattaaaaagtttcattaaacacaaaaaatcacttcattctcatgaagtgatttggtttattttttattttcactgccttttatgtaatcatgcaagattttttcacaaacggatcgatttccggcgacgatactgtttttttctagaaacgttaggcgttctccgtgtatatttgagtagactgcccctacttcatccaaaagcacacagcctgctgcataatcccacggcgcaagccttaacgtgacgtatgcgtcacttctaccgcttgcgatataagcgagctcaagtgcagctgatccaatcgttctcgtccctctcacatcacgcacaagacgggcgaacggtttagcatcaaaataagggctttcgatcgcccaggtcgggttaatgccaacaatggctttttcaatcgctacatcttttaatggaggaagcagggtatcattcatataagccccttctcctttgatcgcatggtaaagctcgtcatgaatgacgtcataaatgagaccgattttcccaatgccattttcaaatatcccgattgaaatggcaaagttgcgtttttgatggacaaagttcattgtgccatcgattggatcaatgatccacacgactccatccagtgaggtcacttcttccccttgtccctcttcacctaaaatatgatgatctgaaaatgtcgcttgtatcttttcaatgaaaaaacgttctgtttctttatcgatatttgtgacaagatcatttggatttgattttgtttcaattgatagaccttcctgcatggacgctttaatacggcttcctgcttcttttacccaaagctttgcaagacggtcaatttccacccagtttgtcatcagactgtaaacctcttttctatgtaatacctatttgtaatagcatactgatattatgtacgtaaaagcaagaaaaaagcagcttcatacaaaaacgaaccgatgaattggttcgtttttacctcaccttgttttaccctttaagctgctcccattcttttcttaggcgctcaagctttcgtttgctgcgttcgatttggatgtcatctttttgctcgatggcttcatgaagcgtagaaagctcatagtccacctctaatctccacacagcgatgcgattcttcttctcctgtctatacccctgcttcacgatttgcttcatttggtcaacgccccttccagagaatgattcattccttgtcagttttcattaataaaaaattcaattgataagagaattggttcttgcttatatcgtatgaagcgatcgcataaccgcaacgacattctgaaaattgtgtctttacctatttgttatgtaccacaaaatcgttgtttttaaacgctgccctacttcctctacaatctttgatctgacggtgcatctttttttgagcttaacccaagctatgataaaatatgatcagcgaaagaatacaggaggcatactatgagtgaaatgcgttttagagatgaagattttgagacatttacagttgacggtttagatgaacgaatgaccgtattaaaagaaagagtccgtccaaagcttgaagcacttggagaacactttgcaccacttctttcttctattacaggtgacgaaatgtttgtacacgtcgcaaagcatgctagaagatcagtcaatccgccaaatgatacgtgggttgcttttgcaaacagcaagcgtgggtataaaaaactccctcattttcaaattgggctttggaaaacacatgtctttgtatggtttgctcttatttatgaatctcctgtgaaaggcgaatatggtcagttattcgaaaaagaactagataccattcagaagaaaataccgcaagattttgtttggtctaaagatcatatgaaaccagatgtcatgcgtcacagcgaactcgatgcagaacagctgaaaacgctgtttgaacgtgtccaaacggtgaaaaaagccgagcttctttgcggtattcagctgcctagagaagaagtcgttcaaatgaataatgaagaattcttatcaaaaatcgaagatgccttccgcacggtgacttatctgtaccgctttacacaaaaacaatctgtataaaaaaaacgagcccatttaggctcgttttttcttacatacgtatcatggcggactcttctgcctctcttgccgttttcactgcacgataaggagaatacccgctttccttttcaaacgctgcacaatgcgtcttttcttctgattttgatggcacaatctctttaaagcgtttataagtatttaataactcttgcttcgctattcctttttcataggctttttcaacagcttgaaaaaacgaaataaccgcaatcttttcctctgtcgtccagtcgacgtccattggatattgatattccatttacttgtccctcactttaacactcatttcttatttgaacttttattatagcatctgttcgatcagaaaccgattgattttatgctttacattccgatcagttcataatataattcttttgttttatgcaatgaaatctgtcgttattggcacaataatagcaggtatttcgacgaaggtgggaaagcaattgtcacaacatgatacacccttatatactggactaaaaaaacacgcagcaaccaatccagttcaatttcacattcctggccataaaaaaggagctggaatggaccctgaatttagagcattcattggcgacaatgcattaagcattgatctcattaatatagaacctcttgatgatttacactcacctcgaggaatgataaaagaagcacaagatttagctgctgaagccttcggtgctgaccatacatttttctgtattcaaggaacaagcggcgccatcatgacaatggtgatgaccgtatgcggacctggggataaaatcatcgttccgcgtaacgtccataaatcgattatgtccgcgattgtattttctggcgcaattcctgtttttattcatccagaaatagacaaagagcttggcatctctcacggcattacaccagaatcagcgaaaaaagcactcacagagcatccagatgcaaaaggtctgcttgtgattaatccgacgtattttggcgtttcagcagacttaaaatcgattgtagacattgctcattcatttcatgtgcctgtccttgttgatgaagcacacggcgtgcatattcattttcatgataagctcccgctatcagccatgcaggcaggtgccgacatggcagcaacaagtgttcataaactcggcggttccctgacccagagctctattttaaatatgaaggaagggcttatctcaaaagatcgcgtgcaatcgattttgagcatgctgacaacaacctctacttcttatttgctcttggcgtcacttgatgtcgctcgaaagcgattagccactgaaggaaaggcacttgcagatgaagccatccgattagctgaattagcgagaaaccgtttgaatcaaattgatggcattacgtgtattggtaaggaaatactcggttcagcttctacgtacgattatgatccaacgaaattaattatttcaattaaagaccttggtctcaatggccatgatgtggaaaaatggctgagagaaagctaccggattgaagtggagctttctgacctttacaacattttatgtattgtgacccctggtgattctgatgaaacaatcgatacgcttataatggctatgaaagacattgctgcagcctctaaaagtgagagcggcacacaagcggtaactgaagtcctgcttcctgagattccatcgcttgccatgacgccgcgtgatgccttttatgccacaactgaagtggttccgtttaaagaagcagcgggccgcatcatcgcagagtttgtcatggtgtacccgccaggcatacctatttttataccaggagagattatcacagaagaaaatatctcctatatctttaaaaacattgaaattgggctccctgtccaaggaccagaagattcaacgctggaaatgatccgtgtcattaaagaacagaaaccaattttataaaaaagaaacatgcagccccaaatggagctgcatgctttttttatttattcagaggcttcatcacagcaatgacagtgaccacacgttccgtatagtgttgtcactttttcattttcaaattgatcaatggtctcattgcaatcttgacaaataattgtacccacgtacattccccttttcttcattcatgatttgaaagcgtttaatctatttcatacttctataatatgatgtcacatttaagttgtcaacggttaattgtatggcacatttaattattttttatgaatatgtgctcttttcttatcatattgagggaacgtttcaattgtattttgcttcatatcaattctgtaacaattgagtaacaatcgaaaattgtcaaaaaggacatgatacactagagtgactaacaggtaaccagctcctaaaaatgttgggacaaccccaaaagattttgaggtgaatagattgaattttatgaggacacttctcattatattccccatgctctttgtacttagttcatgctcatttgcgtatatcataccgaatcagacagaccaagtcagtcatattcaaaaaccaagaattctcttttttacagatgcagaaaatcttgataaagaaagtccttattatgatgcagtcctcgatttaaagaatgaatacccgaaggaaatgtcaaagatgattgtgaaagaagatcgtaaaggctggaaaaatgaagtagaggaattgccggctattttacttgtaaataatgaaaaagtcatagtgaaggttgaaggaaatgtcagcagcaaagaggatattttatcgcccttatgccacgctttagaccgcgtgaatacaaattaatggtctcaccttgcacttatataatccatatgaaaaagcccctcatgaaatgaggggtttttctcatgcaacgctcaaaaaaaccctctccatcaaggagagggttttaataagttcattattttacgatatggattgggcttccaattgctacttcagccgtttccattgtaatttcacctaaagttgggtgagcatgaattgtcattgcgatatcttcagcagtcactccagcttcgattgcaaggctaagctctgaaatcatatcagaagcgccaacacctgcgatttgtgcgccaatcacaagaccatcctctttacgagtgatcatcttcatgaagccatcagttgcgtcaagagaaagtgcacgtccgtttgctgcgaatgggaatttcgctgcaacgatgtcgattccttcttcttttgcttctgcttcagtgtatccaactgttgcaagttctggctcagagaatacaacagcaggaataccaaggtaatcaatttcagctggctctccagcgattgcttcagctgcaattttaccttcgtaagaagctttgtgtgctagtggtggtccatcaacgatgtcaccaattgcatagatgttagaaacgcttgtacggcattgtttgtctgttttgacaactccgcggtcagtcaattcaacaccaacttgctcaagaccaagctcatctgtgtttggacgacgaccaacagtaacaagtacgtaatcagcatcaactgttttttcttcaccttttacttcgaacgtaacagtgacaccatcagatttttcttcaacgccttttgcaagagcgtttgtatggatttcaacgtttccttttttcttcaggttacgtttaaccaatgagctcatttgcttttcgaaacctggaaggatttcgtctccaccttcaaggatgacaacttctgttccaaagtttgcataagcagtaccaagctcagtaccgatatatccaccaccgataacaactaacttcttaggtacttctttaagcgctaaagcaccagttgagttgatcacgcggtctgtgtatttaaaagtaggcaattcaattggacgagatccagttgcaagaattgcatttttgaaagtgtaagtctgtgctgaattttcatccattacacgtacagagttgctgtctacgaaataagcttcacctttaacgatgtctactttatttcctttaagaagaccttgaactccacctgttaatttgtttacaacagaagctttccactcttgaacttttgtgaaatcaactgttacgttttcagctttgatacccatgtcttcagaatgcttagcattttcaaaacgatggccagcattgattaatgcttttgaaggaatacaaccaacgtttagacatacaccgccaagtgttcctttttcaacgattgttactttttgtccaagctgtgcagcacgaatagcagctacatatccaccaggacctgcaccgatgacaagagtatctgtttcgattgggaaatctcctactaccatgacattacgcctccattaaaattaattgtggatcattcaataaacgcttgatgtggttaagggcattttgcgcagtagctccgtcaatcatacggtggtcaaagcttagggaaagagctaagactggagctgcaacgatttcgccatcacgaacaaccgctttttcagcgatacggccaataccaaggatcgctacttctgggtggttgatgactggagtaaaccattgtccaccagcagaaccgatgtttgtgattgtgcaagatgcacctttcatttcagctggagccaatttaccatcacgtgcttttgttgcaagctcgttgatttcgttagacacttcgaaaattgctttgcgatctgcatttttcacaactggaacgagcaagcctttttcagtatcagctgcaattccgatgttgtagtaatgcttttgaacaacttcatctgttttatcatcgatagaagtgttaagtactgggtactttttcaaagcagaagtaagagcttttacaacgtaaggcaagtaagttaacttgattccttgatcagctgcaacttgtttgaattgtttacgatgagcaacaaggttcgttacatcaacttcatccattaatgttacgtgaggagctgtatgcttagagttcaccattgctttcgcgatcgctttgcggattccgctcattttctcgcgagtttctgggaattctccttcaagaactggagctgctgctgccgctttaggagctgcttcttctttcgcactttcagctgcttgaggcgctgcttcttgagctgcagaaccaccattaacgaagctatcgatatcttcttttaacacacgtccgtttttaccagaacctgcaactttgtaaatttcaatgcctttttcgcgagcatatttacgtacagatggcatagcgataacgcgtttgtttggatcagcatctacttgctcttgtgcgcctgcaccagttgctgctgccgcttcttcttgtgccacttctttcttttctggctcgttaccagcttcagcagtaccttgtacttgagcttcagtttttgcttcgccttcttcttcgctgcctttaaattgaagattttcgtaaccaggtgcatcaaacgtaatgattgtttgtcctacagttgcaactgttccctcttcaacttttaattctaatacttttcctttaacaggtgaaggaatttctacaactgctttatcgttttgtacctctgctaaaacgtcatcttcattaatttcgtcgtttggttttacaaaccacttaacgatctcaccttcgtggataccttctccgatgtccggaagtttaaattcaaatgccactgtttttcgcctcctagattttgttgaatccttgttgtgtatgtttacacggtcttgtaattgataaaggggaagagaaataaattcttttcccctcagtcatttaattaaaattcaagaactttcttagctgtttcaagcacgtctttatggtttggaagccatacactctcagcttgagagaaagcaaatacagtatcaggtgcagctacacgaagtactggtgcttctaggctaaggattgctctgtcattgatttcagctactacgtttgcagcaataccagcttgtttttgtgcttcttgaacaacgatcgcacgacctgttttttcaacagaagcgatgattgtttcaatatcaagcgggcttactgtacgaaggtcgattacttcagcagaaacgccttctttttcaagctcttcagcagctttaagtgattcgtgaaccattgcaccgtaagtgatgattgaaaggtcagaaccttcacgtttcacgtcagctttaccgatttcaattgtgtactcttcttcaggaacttcctgacggaaagagcgataaagtttcatatgctcaaggaatacaaccggatcattgtcgcggattgcagaaattaatagtccttttgcatcgtaaggtgttgaaggaataaccaccttgataccaggctgttgtgcgataagaccttctaagctgtcagcgtgaagctcaggtgtgtgaactcccccaccgaatggagaacggattgtcactggagaatgccagcgtccgccagaacggtaacgcatacgagccatttgtccagaaacagaatctaatacttcgtaaacgaatccgaagaattgaatttccattactgggcggaattcttgtagtccaaggccaattgcaagaccgccaataccagattcagcaagtggtgtatcgaatacacgatcctcaccaaactctttttgcaatccttcagtcgcacggaatacgccgccgtttttaccaacgtcttctccgaaaacgagaacgttttcgtcatttttcagttctgtgcgtaacgcatcagtgatcgcttgaatcattgtcatttgcgccatggcttacttcgactccttctgtttgtaaatttcaagctgttcaactaagttgaatggttttacatcgtacatgttttcaatcaagtcagtgactttttgcttaggctgttcgtcagcttctttgatcgcttgtttgatttgttcttttgcatcttcgatgactttattctcttcttcttcagaccataggcctttgttttccaagaatttgcggtagcgtaccaatggatctttttgctcccactcgttttcatcttcttttgtacgatatcttgttggatcgtcaccagccattgtatgtgggccgtaacggaatgtaagagtttcgattaatgttggaccttcgccattaacagcacgctcacgagcttcagcagttgctgcatatacagctaatgcatccataccgtcaacttgtacgcctacgataccagctgcagccgctttttgtgcaattgtttgcgcagcagattgcttctcaacaggagtagagatcgcatatctgttgttttggacaacaaaaatcgctggcgctttgtaagcccctgcaaagttaataccttcgtagaaatcaccttgtgaagctccgccatcaccagtgtaagtgattgcaacagcatttttaccgcgctttttcaaaccaagagctacaccagcagcttgaatgatttgtgcaccgataatgatttgtggtgaaagtgcattcacatcttcaggcatttggttaccaacaaagtgtccacgagagaacaagaacgcttttgttaatggaaggccatgccagattaattgtggtacatcacgatatcctggaagaatgaaatcttctttctcaagtgcaaagtgagttgcaagctgagaagcctcttgtccagctgttggcgcatagaagccaagacgtccttgacggttcaatgaaattgaacgttgatctaatactcgtgtaaacaccatacggcgcattaattcttttaattggtcatctgagagatccggcattgccgcttcgtttacgacttcgcctttttcgtttaaaatttgaaacgtttcaaactgctttttgatggcatcaaattgctttttgctatcaacaattgctttttttgtttttgcagccattctaaagtcacctcttcctttcttttaacagtcaatttgtcgtgaatccatttatacatacagatataggataacccaaaatacgcatatgactcctgtatataatagccactgggatcgttgtcgaaacattgaatgatcactcgtttttgagttcttctaactgtattaacgatagttcacaaataactaatacaacttctgttaacaaggactagtttacaacaagaaaaatagtccgtcaattgatttaacggctttatttaaataaatgtattcgctttactttttatggtgagctgtatcaatctgtttaacaaacaactctaactgtactagtatagagtgtactactgtactacaatagaaaatgtttgtttttgtcgaaaaataaaaaaagagctgttttttcagctctctttggactcttgatctgcggcttcagacaaagcctgtttatgctcattcaattgctttgtatattgattgaactttttaccttcttttctgactttgctataagaacgattcactgtcttcaacttggatttcagctctttatatcctaagtccttcttttttaaagattgatacaaatgctgatcttgtttcagcgccttttgatattccttgtaaagctggtcatacgacgcatatcttttctcgagcgatttgaccgtttcatctgctttttcttttaaatccgtatcttgtatacgtcccgcagattctttgaccgttttcaattcttttttcgattcatccatactgtctttttctgttttcaaatgttcttctcgtttcgctgcagatgctaacgcctgatcagaaaggcttgacactgtttttgtgtgatcctttgtggtttgtatcatttttttatagagctgctgttcttttttctcatagctttgcagtgtgccttgctctttttcaaaagaggcctctttttcgctcattttcgtcatcgcatcttgcatgtcatgaaatgaactttgacctccgcatcccgtcagcaaaagggtacatatccccgctaaagcagcacctgctttcatgcttcttcttatttgtttcatcacaaggttccccctttatatctccacatacaactataatttttataggcgtttgtgacaaggaaagaggtcattctgatgagccgaagaagatttttttcaagtgataggcgcatgactatacaaatagtgcattcatacatagtttatattacacgcttcgccttcacttatgagaggccgagtgtatttccaaaggaggtcaaaagtatgtctaattatagtcatggaagtatgtatggtggatacggcggttacgggtatggatacggtggcggatatggtggtggctgttgttacccaagttatggcggtggttacggatacggtggaggacgcacattcgctttaatcgttgtccttttcatcctattaatcatcgttggcgcagcattcttaggcggcggtggctgctgctaatggctgtttaagcctctgaccggtctcatagaccggtcttctttatttcattgcatatgttgtgtaacattttatatactttacatacaaaggaaataggagtgaagatttgtgattaccatggaagatatcgtacgggacggacatcccgtcttaagacaaacagctgaagccgtcgagctcccgccgacagaagaggaaaaacagcaattagctgacatgattgaattcgtcaaaaatagtcaagatgctgacttggctgaaaagtatggactcagacctggcgttggactcgcggctccgcaaattaatgtcagtaagcgaatgatcgctgttcactgtgaggatgaagatggagaggaatacagctatgcccttttcaacccgcgcattgtcagtcattccgtcaaaagagcttatttaacgacaggtgaaggctgcttatctgttgatgaagccattcctggatttgtcccgcgatatcaaaagatcagggtgaaggccacaacgcttgaaggagaagacattgatattcgcctaaaagggtttccagccattgtatttcagcatgaaatcgaccatttaaacggcattatgttttatgatcatattcaaaaggatcagccattcgctgagccagacaactctgttgcgatcggcagatcataaattaaaaagaagacccaataacctcagggtcttctttttttattcttcaatcaagcctagatgggtcactgcatagaatatgccgtcttcatctaccggctttgtcacaaaatcagccaaatcttttagttcattcacagcatttcccatggcgacacctgtaccagcaaacgaaatcatctctcgatcgttcagaccgtctccaaaggcaacggtatccttttgctcgtaaggcagtctttcgataactcgtttaatgccttcagctttcgaaccgccctttggcaagacatctgttgacaactcgtgccacctgacaagatcaatttcttcgcggaacgcctcgtattggacttcctcttctgccttacagaataacagcatttgaaaaatctcgttttctttaaagtaagacaaatcatgttcaggatgctctgtttttaaagtcccaatcccctcatggataaacggatgatttggcacagaagccttcatcgctttttcccccatgaaaacaagcggatgatcataacgatctgccgtttcataaattttctccatcagctccagtttaagcggattgccgtaaatgacttctccctcatacatgacatactgaccgttataagcaataaaggagtcaagccctaattcctctaaaataggcttaattaaaaaaggcgaacgcccagatgcaatgaagagatgatggcctttttcttttaataaacgaactgctctcttcgttgattcaggtatttttttatcatgatcatataaagtaccgtcgatatcaaagaagatgacttttttattcatatcccgtctcctgtctcctgttatgtatacccactccctttcatcatacagaaagatttatgctttcgaaaccaattcctatgaaaacgcccatttcccacatataaccatgtaacattcaatggaaacgtcatataatacaagtataaagagagaacggaatacaaggtctaatctcacttcaattcgaaaggaggcgacctgtgatgcttcgtcgtctgcgcaagaaaattagaagacaatggaaggacatgcttcgtaaaaaatcgatcgcttaaaaggatcttccgcacatttgctgagggtccttttttctcagagacttttcttatgcgcgtttttttaatataatagaaatagcgagtgtaacatacggtatttaaggagagatttggatgatatataaggtattttttcaggcaactactactgaggtacctgtaagagaacacacagattcactatacgttgaagcggtttctgaaagagacgtacgcgataagttgaaaaaacatagctacaacattgaattcattcagcctgtagacggtgcttttttagactatgaacgagaaagtgaaaattttaaagtattggagctatgagaggaatgaaatttgtaaaaaacgatcaggcggcagtttttgcgctcggcggtttaggcgagatcggtaaaaacacgtatggcgttcaatttcaagatgaaatcattttaattgatgctggtattaagttccctgaagatgagcttcttggaattgactacgtcatccctgactatacgtacttagttaaaaacgaagataaaatcaaaggtcttttcatcactcacggacatgaagaccacatcggcggtatcccttaccttctcaagcaagtgaatattccagtttacggcggcaaactcgcaatcggcctacttcgtaataaattggaagagcatggtctcttgagacagacaaaacttcacatttttgaagaagaggataccattaaatttagaaaaacagctgtgtctttctttagaacaacacacagtattccagattcttatggaattgtcgtgaagacacctcctggtaacatcgtacatacaggtgatttcaagtttgactttacgcctgttggcgagcctgccaacttaacaaaaatggctgaaatcgggaaagaaggcgttctatgtcttttatccgatagtacaaacagtgaaattccagaatttacgatgtctgaaagacgcgtaggtgaaagcattgatgacatctttagaaaagtcgacggccgtatcatctttgctacgtttgcttcaaacattcacagacttcagcaagtgatcgagtccgctgttgccaatggccgaaaagttgcggtgtttggacgaagtatggagtctgctattgatattggacaagatcttggctacattaaatgtccaaaaaacacgttcattgaacacaatgaaatcaaccgtctaccagcaaacaaagtgacgattctttgtactgggagccaaggtgagccgatggctgctctttctcgtattgcaaacggcactcaccgccagatttcgattaatcctggagacactgttgtcttctcatcttcaccgattccgggtaacaatattagtgtaagccgcaccattaaccagctgtaccgtgctggcgctgaggtcattcatggctcacttaataatattcatacatctggtcacggcggacaagaagaacaaaagctgatgctccgtttaattaaaccaaaattctttatgccgattcacggtgaataccgcatgcaaaaaacgcatattaaactggcgaatgattgcggaattcctgaggaaaactgctttatcatggataatggtgaagttcttgcactaaaaggtgacgaagcaagtgtcgctggcaaaatcccttcaggaaacgtatatatcgacggaagcggaattggcgatatcgggaatatcgtcttaagagaccgacgcattctttcagaagaaggtcttgtcattgtagtcgtcagcatggacatgaaagaattcaaaatctctgctggtcctgatctcatctcaagaggctttgtctacatgagagaatctggcgacctcatcaacgacgcacaagatctcatttcaaagcatcttgaaaaagtaatggaacgtaagacaactcagtggtcggaaattaagaacgaaattacggacacacttgctcctttcctttacgaaaaaacaagacgccgcccaatgatcttaccgattattatggaagtgtaatcaaaaaagagacacaagccgactggctgtgtctctttttttcatcaagtattaaaaaagccgcatatatacatcgtacacatgcggtttctcactttttatgattgaattgggaggtgctgaaagcttctgacatcaaacaagccctttgtcgtcattttcacatcaggaatgactggaagtgccaagaaggacagcgtcaaaaacggattaaagtctaaggaaaaaccagtttcttttagcgcttcatgaagtgtatgaaggctttcattgacgagatgtgccggctgatctgacaacaaaccagagattggtaatggcagcgtatgaagtgactgcccttctttcacaacagtcaaaccgccgcctgcttcttttaacgcctcaatcgctttgatgatatcagcatcatttgtaccaactgcaattaagttatgtgaatcatgtgcaactgttgttgcaatggcgccctgtttgatgccgaagccgctgacaatccctacgcccatttcagataaaccttgatgacgttcaacaagcaccattttcaatacatctctgcctgtatcacttgtaaattgtccgttcatttctgaaggagagacttgttctaactttgtttcaagctgattcggaataatacggatgacattcatatgttgatcgcctgtgataggcagtgcaatgtcttccttttgaacatctacggcatgaacagattgtaataatgccgggctcggtgcaatcttttcgacactcggcttatactctccgttctgtgcaaccaatcgacctgcgataaatacacttgtaatgtctacatgatgaaagtctgagacaagcataaaatcagcatcatagcctggtgcaatggctccctttgttttaagaccaaaacactctgcggcatttaagcttcccatttgataggctaaaaatggatctaagccttcttttatggacatccgtacttgctcgtcaatacttccctgtgccattaaatcatccaaatgtttatcatctgtacaaaagaaaaagcgtctcgcattcttctcattcactgcgggtaaaacatttttcacgtttttggcaacagatccttctctcagcatcacatacatgcctcttttcacacgctcaagggcttcctgtgctgttgtcacctcatggtctgtttggacactcgctgtccggtagacgttgattaatcgatctgttaagcctgctagatggccgtcaatcagtttattctcgttttgagtatcaagcagcttttgaagcatatcttcttctgcctgctccacaccaacatagtccatcacctcagcaagaccaagcacttccttttcttgataaagaggttttaaatcttgcgcttttaacgtagcacctgatcgttcaaaactgactgccggtacacaagatggcagcatgaaataaatatgtaaggcagctttcctcgcttcttccagcataaaacggatgcctgttatacctgacacattggcgatttcatgcggatctgttacaacagttgtcacgccgtgaggaacgacagctttggagaattcagcaggggtcaccatagaagactcgatatgaacgtggccatcaataaaaccaggcacaagcatttgacctgatgcatctagctcctgttctccttcgtactctcctatcccaacgatttgtccattttcaacagcgacatctgcatctatccattcctggttaaacacatccatgactttcgcatgtttaatcacgagggctgctttttttctctttgctgctacctcaatttgatgtctgaaaagctccttatccaacgacactgcctcctccaagtaaacaatataatgtttcttatcgtaaacgaatctgtttgcccagtcaatgacatttagagaaaatcaaccatatcaaaacactgatttttatttctgaatagtgataattgcatgaaaaatattacgacttatttttgcggttatacagaacaacgcagcccttttcagtgtctatttccatctcaatgtccacctgtcatgaacacattcatataaaaaaacaccccgtcatcggagtgtttaataatcgttctgcatttctcgtttttcaaagcgtcctatatcggctactgccccaatgacaatgaggatatcttctttttgaatcatttcatcagccagcggggaaacaatgacttcctttccgcgcttaatcgcaacaatattgataccgtatcttgccctaatatcaagatctaaaagagaatgccctgcaagcctgttgtttgcaacaatctcaatcaggctgtactcatctgacagctcaaggtaatcaagcacgttatttgaaatgattttatgtgcaatccgtctccccatatctcgctctggatgaacgacgcgatccgctccaattttgtttagcaccttttcatggtaatcattttgcgctttcactgtgaccattttgacgccaagctctttcagcataatcgttgttaaaatacttgcctgaatgttttcgccaattgcaacgatgacatgatcaaaattgcgaataccaagattttttaaaacgttttcgtccgtcgaatcaccaatcaccgcatgtgaggcaattttcgcgtactcgtttactcgatcttcattcatatccattgccatgacttcaagtccttcttcgctcagcgccttgcaaatacttccaccaaagcgtccaagaccaatgactgcatattcctttttcatgttcagactccttttatctcacttaccatgcattttactacggtttgattaatgaatccatatgtgaacgaatttttttgcggaacgcttcacttaagtaaaggtctgctcctttttcgatttcactgcgataatgagctggcggagcgatttcttcgcttttttgaagcacaagaaaggttaaacagtcctcgtaaatttgatcacctattttgacatcgacaaatgctggacgatatgtaccttcataaactccttctcgtttatacaaataacgaatggcatcaaaaggaacttcatataaaacaccctctgtttcgccgccgtcttctaccatatcagctcttgatccatctggcctcaccaatgtaaatctcgtagtaaaaccatttagtacaccaccgccgatgatttgtttaaagtgatgatcgacttctgcgagcttaaacctagcatcatccatgcaggaaccataggcaaaataatagaaggttgatggcttctgctgccaaagttgataagctttccagcaccctctctttatttctttcagcgctgatgccttctgctctggcaaagtgtatgtcacggctgctacccgaccttgatccgtcatgatattgatttcctgcttgtcatacccttcctctagtacgtctatcttattcaacgtgtcagcggttacctcgtacaattccccgaatacagtgcctttttctgcaggaacacacgctggatatccttgacctgtatcgtaaatccttccactcatccaagcggattttgctaatagtttgttttccttcaagtacgtttcgtggtgctcttcatgctgcaatagcgtcccatatacaaataaagcttttaccgtcatgacttcacgtcctctcaacttgctgctgtctgcttttttgacacacaggcaaataaatatgaaaagctgtgcctttcccaagctcacttgacacgtccattcttccgtgatgatcttttaaaattgtcgcacagatggtcagaccaagccctgtcccttcttttttcgtggaaaagaaaggatcatatattttttgaatatcttcttcagacatcccttttccttcatcttgaatggtaatcttccattcattcaatactttttctgtagatatgtatatgctgccaccttcaggcattgcctcaatcgcatttttgattaaattaatgaacagctgcttcatttggttagcgtctgctaggattgcgccggcatcctgccttttaaatggctgcttgagatcaatatttgaaagaacggcatttgtttttaataaagtaatcacttgttctagaagctcatgaagctggacctcttgaaaatggaccgattgaggcttagccaatacaagcagctcacttaaaacaaaatcaatccgtttaatttcagaaaagataatgtcaaaataatcggttctttcaggatattgagtcttcatcagctgcaaaaaaccattaactgatgtcagtggatttctgacttcatgggcgattccagcggctatttgtccagcgacggccagcttttgcgcctgcatttgcaattgctgattggatctttcaagctcaagctttgcctgcttttgtttcgtaatatcagctaccgttccaattcctccggtaaactggtgatgctcatcaaaataaagcttgtaatgaacatctccccacaccttctttccctctttatggagaagctgcagttctacacgccccgcatccttatgctccttgatcacagacaataaatgctggaccacgcgttcctcttgatcaaagtactgattgtacatggtacctagacattcatcgatgtcatagcccgtcatttgtgtccatgcttgatttaagaaaataatttcacctttttcgtttgtttcaaacacgatttcttgcaagttatctgtgattcgattcagccgctctgtcagttcgtgtgcttctttctctctcgtatttaagtctgacacaagtagatttaagcggtctacatagcctgagacaacccagattcctgttagaaccaggactgtaaaggctagatcgagcggccaattaatttgatagccacctagataataaaagaaatcccagcttaaaattaaaataaatgcaagaacagataacaagatccgcacttgatatgttttgttcaaatgattccacctgccgccctgagattctttgtcaattgtaccattttccacttgttttttgagggagatggggcatttttaaggaactttttcagaaaaaaagcctgttctcagcacaaaggaagagatcaggcttttttcattactgctgaagagcttcttgaagttcttttaacagtaattctgcgccttcagcgcttaatgtaatttgaccatttccataatcatggttctctgatgtaatctcaccagtcatgaggcaaacaccctctggctgatattttttcaagacgattttatccccatctataaaaaattccatactgtctttaatagcaatatcaagtgctcttcttaattcgattggcatcacaatacgccctagttcgtctacttttcttacgactccgatagatttcaaattcgttccctctttctttcattagctcaagatcaatctgtttttcaccaattgatatatcgtagacgtaagagattctcaaaaggtttctcttctataaaattttttttcacaaaagaaaaaacaaagggaaaatttattgtgattgtcaaaatgatactcgaattttacaagttcatttcaaggtcatcacaaacccccacaaatgacctcaaccctctgaacttttaaatgtaaaattgtttaaaacagcaaaaatagagattgggtgaaaacatgtttcaaaatgccgaaattggaattgatttaggaacagctaacatattggtttatagtaaaaataaggggattattttaaatgaaccgtccgtcgtggcagtcgatacagaaacaaaaactgtacttgcagtcggaacagaagcaaaagaaatgattgggaaaacacctgggaaaattgtggcgatccgtccaatgaaagacggtgtcatcgctgattatgatatgacaacagatttactcaaacaaatcatgaaaaaagcaggaaaaaatatcgggtttaccttcagaaaaccaacggtcgtcgtatgtacaccttctggttccacagctgttgagcgccgtgccatcagtgatgctgtgaaaaactgcggagcaaagcacgtgcatttaatagaagaacctgttgcagccgcaatcggtgctgatcttccagtagatgagcctgttgcaaacgtcgtagtcgatattggcggaggaacaacggaagttgctatcatttcgtttggcggcgttgtctcttgtcattccattcgaattggcggagatcagctggatgaagatatcattacctttgtgcggaagaaatataacctattaatcggcgaacggacagctgagcaggtgaaaatggaaattggttatggtctcattgagcatgagccagagtcattagaagtacgtggacgtgatttagtgacaggtcttccaaaaacgatcacacttgaatctcatgaaattcaaggagccatgcgagagtcacttcttcatattttagaggcgattcgtgccacattagaggacagccctccagagcttagtggtgacatcgtagaccgcggcgtgatcttaactggcggtggcgctttgttaaacgggattcaagaatggctctcacaggaaattgtcgttccagttcatattgcagcaaatccacttgaatctgtcgcaatcggaacaggtcgttcactagaagtcattcacaaattgcaaaaaacattaaaataatcttcttgttctacttctttttttatcatttcgatcatatcgtgaggaatggataaacgtgaaggaggaagaacatgttgcttgatttaggtaaacgggttgttgtcacagtcattttaacgggtattatcttaggaggaatgagcctgtcattttcacatatgcccccttctaacgcacagcctgtgaaacaactgaaccgctaaaaaagccgcatgaaagcggcttttttattttggcttttcgcgcgtgctccccattttccttttcggtcttaaatctgatatgatgaacatgactaaaggagggtttttttatgagttcatttgaaaaacaactagatcaatatgcgaagaccatcgttgaagtcggtgtgaatgttcaaaaagaacaagaagtcatcgtatctgcatctactgaatctgcagaccttgttcgtcttgtcgcgaaacatgcatatgagcgcggggcgaaaaacgtacatatccgctgggctgacggtgttcttgctcgtttaaaatatgagcacgcaccgcaggatgtgtttgagcaattcccagaatgggaagcacagatgatggaaaccatcgcaaaacgcggcggcgcttttatcacgatcttgtcagaaagccctgaccttctgcgaggcattgattcgaaaaaaatcgctgcacagcaaaaagccgctggatctgcccttcatacatatcgccaatacgttcaatcagacaaagtggcttggacggttgtaggcgctgcatcaaaagattgggcgaaaaagatcttccctgaccataaagatgaagaagctgtcgctttattatgggaacaaatctttaaagtcgctcgcgctgatcaagcagatcctgtggaggcttggaaaaagcacgatgagtcgctaaatgaaaaggtcaaaatcctaaatgagcgccactaccacaagcttcattatgatgctcctggtactgatttaacgattgagctccctgagcagcacatttgggtaggtgccggcagcgtgagtgagcgcggcgtctctttcatggccaacatgccaacagaagaagtttttaccgtacctaaaaaagatggtgtaaatgggacagtctcaagcacaaaaccgctcagctatgcaggaaatatcattgatgagtttactttaacatttgaaaatggccgaattgtcgatgtgaaagcgaaggaaggcgaagacattttaacttcgctcgttgaaacagatgaaggctctcattatctaggtgaagttgctctcgtaccagatgattcaccaatctcaaactcgaatattctctattacaataccctttatgatgaaaacgcatcgaaccaccttgccatcggcagcggatatgcgttcaatatcgaaggcggaaaagagatgaatcgtgaagaattggatgcagctggtgtaaacaacagtattacacacgtcgatttcatgattggttcaaaggaaatgaatattgacggtattacaaaagacgggaaacgcgaaccgatcttccgtaatggaaactgggcgatttaaccgaaaaaaagacatccacaaatggatgtctttttttatttacgcataaagctcaacgagtctcttttgaatctcttgatctgataagaactcatcatatgttgtttgtttatcgacgatgccatttggcgtcacttcgatgatacggtttgccactgtttcaacaaactgatggtcatgagatgagaagagcatcgctcctttaaagctcattaaaccgttattcagcgccgtaatggattctaggtctaagtggttcgtcggctcatctagaagcagtacattcgctcctgacagcatcatttttgataacatacaacgaaccttttctcctcctgataagacgcttgcttttttctttacttcttccccagagaaaagcatacgtcctaagaatccgcgtaagaagctttcgctttgatcattaggagaatactggcgaagccaatccactagatcgacatcgtttccttcaaagtattcactattgtctttcgggaaaaaggcttgagatgttgtgacgccccatttatatgtcccgctgtctggctccatctcaccagcaagaattttaaataaagtagacacagcaagctcattacggcttaggaacgcaattttatcctcgcgattcataataaagctgacgttatcaagtactttcacaccgtcaattgttttcgatagaccttctacttgaaggacatcattcccgatttcgcgctctggcgcaaaatggacatacggatatttacgtgaagatggcttaatatcgtctaaagagattttatcaagcaatttctttcttgacgtcgcttgcttcgatttagaagcattcgcactgaaccgggcaacgaactcttgaagctgcttaatttgctcttcttttttcttatttgcatcttggctgagtttcagcgctagctggctggactcataccagaaatcatagtttccgacatatacttgaatttttccgaagtctaggtccgcaatatgtgtacatactttgtttaagaagtgacggtcatgcgaaacgacgatgacggtattttcaaaatgaataaggaactcttccagccactggatggcttgtaagtccaagtggtttgttggctcatccagaagaaggacgtcaggcttaccaaataaagcttgggctagtagtactttaaccttttcagaaccaccaagctcagacattttcttcgattgaaggctctctggaatgccaagaccttttagtaagatcgctgcttcactttctgcttcccagccgtttaactcagcgaactcaccttcaagctctgctgcacgaatcccgtcttcatctgagaaatcaggtttcatatagatcgcatctttctcctgcatcacatcatataaacgtttgtgacccatcatgacgacttttaatacttcaaattcttcgtattcaaagtggttctgttttaagatcgctaaacgctcaccagggctcatatgaacatcgcccgtctgagcctcaatttcacctgaaagaatctttagaaacgttgatttcccagctccattggcaccaattaaaccgtagcagttgccaggagtgaatttaatgtttacttcttcaaatagtttacgatcagcaaaacgtaaactaacattatttactgcaatcatttattaatcctccatcactcattcatcattatgaagtataacatgaataacgtttgatagaaacgtctctcactaagaacgaaggcaaattgtccaatatggtataataagtgggaatgatttattgaaggagttcgtgcgatttgagattacttacactgatggaatactgtttattgattttctttatgggtatttatttatctgcaacaggatttaatgcgagtgatttcggcctttatattgggcttgtgcttatttacacactggtacacatcttttcgaaacgctttttacaaaaacgagggaaagaaaatcataagatcggattgtttcggtccgttttagctattactggctctgtcttcgcttctgtgctggccattgtgctcattgttacagtgctcacgccaaattaaaaacgaccctatttttaagggccgcccatttaagcacttttctcatgcacctgagaagggtgcttttattttgtttgccgaatgtcgccaaatgggaagaaaacaaattctgatgtcccgacaacccgatcattttcaatgagtccaaggccatttctgctgtccatggagttgagcctgttgtcccccatcacaaagtaatcgtttttcggtactttcactggaccaaaatcccctgtcaaatgcacttcatactctttcgcatgtgccttgttctcttttaaataaggctcatctacttttttaccattaatgtaaagcgtatcatccttcatttcaatcgtgtctcccggaagaccgatcaatcgttttacataatgaattttctggccgtcttttccattaataatcacgatgtcacctcgtttgacaccacctagatagttaatggttttgttgacgaacagcttttccccatcatgaagggtcggttccattgactctccttccaccacatacggctcaaatataaacgtacggatgagcaagacgagcgcaagtgcaattaaaatggctttgatccattcaaacagtgaacttttcttctctgttttggcttgctttgcatcagattgaatatcattttcgttttgtttgttttcttcgttcaaaatactgcttcctcctaagactttctgctaaaagacttgaaacgtgaattgaataactttactttatcacatgtcatttaaaaattcacaagacaaccattcaattagatattttttcctaatttgttcgtaattaaacaaaaaagaaacaccgcttttcacgatgcttctcctctgaattacgcttctagtttcactggttttttcaaaataccaagtaaaatcgctgttacaacggcaccgattaagatgctgatgatataaagaattggatgatttgttacccagaaaacgaatagtccgccgtgcggtgcaggaagcgtgactctaaagaattccgttaatccgccagccacagctgctccaatgacagctgaaggaatcacgcgtagagggtcagccgctgcaaacgggattgccccttcagtaatgaaggcagctcccatgaagtagcatgtaatccctgcttctcgatcacgttttgagaacttatttctaaagattgttgtcgcaagtgcaatacctagtggtggtaccattccgcctgccataatggcagcgtgcggtgcatagtttccagcagcaatcatcgcaagaccaaatgtgtaagccgctttgttaattggaccacccatatcaatcgccatcatacctgccaaaataatacccattaagacaaggtttccagtacctaaagtttcaagccaatgagttaatccgtccatcaccatttttactggtgtgttcacaatgtaatgcatgatgatacctgtgaagaaaataccgaacaatggatacagcagaactggcttaatcccgtcgagtgactgcggtacaaatgtgaatacttttttaagtaacacaacgacataaccagcaaggaaaccggcaatgagtccacctaggaatcctgcacctgctgctgacgccataaatccaccgaccatacctggcgcaaaacctggacgatctgcaatactcatcgcaataaatccggctaatacagcgacgattaaggcaagcgcattatctccgccaattccttttaatacagctgcaaatgaattaaatgaagggtctttaggatctgctgagttaattccccagaagaatgaaattgcaacaaggataccgcctccgacaacaaatggaagcatgttgcttacaccgctcattaagtgcttgtagaaaccacttctacctttgccagatgactcatgttcgtcttttgaagaactgccgccagagcctttatagatcggtgcatcttgattgactgctttttcaatcaattcctgcggacgacggattcctgctgtcacaggcacttcaatgacatgtttgcctttaaagcgttccatttcaacttgcttgtccgctgccacaatgatggctggtgcttcttcaatttcttttgcggtaagagcgtgtttaataccaccagagccgtttgtttcgactttaatgtcaacgcccatttctttcgctttttctttcaaagcatctgctgccataaatgtatgtgcaatacccgttgggcaagctgttactgctaaaatcttagcaggtttacctgctggagctggttcctcttgaacttcctcttcttcttcatcgtccttgtcatgcgtattgatgatatcgatgatttcatcttcagtagccgcttcaagaagctgctttctgatttcttcacgcatcagaagtgttgataaacgagaaagtgcttctaaatgcgtgttgtttgcgccttcagttgctgcaatcataaagacaagatgactcggctgcgcatccagtgattcataatctacaccagctgtcgagcggccaaatgcaatagcaggctctttgacacttgctgttttagcgtgaggaatcgcaattccttctccaataccagtagagctttgtttttcacggttgatcaccgcttctttgtagccctctttatcatttaacttgccagctgtatctaaaacagtgactagttcttcaatgactgcttctttctgctggctgtctaattgaagcttaatggtctgctttgtgagtagttctgttattttcatggtgactcctcctttaaatgcgtgtgacttttacttgtggtaatagtgtgtcaacaagctcttttgtcccaagctcctcagaaaatgctgtagcactgcctgatgtgacgccaagcttaaatgattcttcaatcgaaaggcctttcgaaacgccggctaaaaatcctgcaacgactgaatcccctgcaccaaccgaattaacaagtgtaccctttggaacattggactgataaatcccttccttactgaataagagagcgccattaccagccatggatacaataacatgttcagcaccttgttctaacagcttctttccataaggaatggcttcttctgcagtagagatgctcgtctcaaacatttcacctagttcatgatgatttggcttcattaagaacggtttcaagcctgctgctttttttagggcttctccagaaatatcaaggacaactctaacgccttgcttttcacatacctcagcaatacgttcatatgtgttatgaggcaatgaagaaggaatgctgccagctaacacaacgacatctccttcaatcaatgaagtaaattgagacagaaacgactcaaattgtgcttcagtaatggatgggccgagtccgttgatttcggtttcttcacctgtttttagtttcacattaattcgtgtatcttctgacacctcgtgaaaggctgtttgtaattgttcgttttgtaaaaagtcttgaatatatttgcctgtaaatccgcctataaatccaagcgcttttgattccacaccgtgacgttttaaaagccttgagacattgatcccttttccgcccggatattttttgtcataggttgaacgattcaaaccgccgactgcgaaatcctccacgtgtacgatgtaatcaactgatgggtttaaagtaactgtataaatcatgttttcactacctttataaccgttttttcatggtaattatcgaatgaatcttcttttgcgtcgtttgtgataatggtggcttcctgtaaactagcaaaggttgaaaacgatatttcgccaaacttggaggcatctgttaagatataggttttttttgcctgcttcatggccctttttttcatgagcgcttcctctggatcaggtgttgtaaatcctgcctcgggatgaatgccattcgtcccaacaaagcttttgtcaaaacggtaattttccatcgccgtcaaagctgcggcaccgaccatggctcctgttcgatgtttcactgatccgcctatcaggtaaaaagaaataccttttctcatgagtgcttcaatgtgcataacaccgtttgtcaccacaacaatatcttgatctggatcgatatattcaatcatttgctgtgtggtcgtaccagcgtctaaataaatacaatctccctgttttaaaagtgaagcagctgcctccgcaatcaatgacttttcttgaaggtttttggcagatttctcaaatacatctggttcaagacggatacttgatatcttggctgctcccccatggaccctttttagaaatcctttttcttcaagggctgataaatcccttctaatagtagattcagacgcatccgtcataatcgttaagtcctgtattttgatgacatcattttcttctaaacagtcaataatgagttgatgtctttccggtgttaacatggaaacacccccttttgaaaacgtattcattttgcgcgcacctttattgtaatcgcttttttcaacattatcaatacaaaacaatcaaatacattcaataactatcaaaatctttcaccatggtcatcttacctttatatgtaccatttgtaaactgaaaaatatgtgacattaagatgaaagtcatgatcttagcatttctatcatttttcatttcattcaatagaactaaaaaaagcttttatgcgatgtgcataaaagcttttgatccttgattacagcggaattcacactgtttgtatgcttttggttcttctcgaaattattcgtatctaagagaatcaataggatctagtcttgctgctttattcgcaggaattaacccaaaaacaatcccaattagcatactaaacagcacacctacacagatgatttgccaagatactaaggatggccagccggcaatgagtgatactaacgaggcaccgcctatacctagtgcaatccccatcaacccgccgatcaaggttaagacgacagactcaattaaaaattgaacgagtatttgagccctcgttgctccaatcgcttttcggataccgatttcccttgtcctctctgtcacagaaacaagcataatattcatcacgccgatacctccgacaagtaaggaaattccagctattgagccaatgattgttgtcatgacagacgtgatttgaccgatgccttctgcgatttcttccatgttgatcatttcataagcatcttctgtatgatgattctcatttaataatgcagccgcattctttcctacttccttcatttgatcagcatgtgcgacttgaattgacaacttatcgtattcactgatcccaaatgtggaggtgagcatggcgaatgggacatatatttcattcatatcgaatgaaagcatccctttttgtttggctaaaacaccgatgacttcaaccggctgtccgttcatccaaatcatttcgcccaatgccttctgtccattaaataattctttttgtaagccttcagagataagggcggctcttctgccgcttctaaagtcaatatctcttaaattctgtccttcggctatttgtaatgaatgtacattcgtatacccttcatttataccgttaactgtcgcatccactgtcgtatcttgaaatctcagctgcattccttgcgcagtcgaagatgcaacctgattcaccccattgattgtcttaatgcttttgatgtcttcctcagtaaatgcggcgtcgaataaagcgttgggatttgcatttaactcttcgtcagagggcgtatacatcatatcaacggtattgtttggacctgaaatcgacccttttagcatttgctcgccgccttgaccgatagccacgaccgcaatgactgatccaacaccaataataatcccaagcatcgttaaaatagaacgtaatttatgagctaaaacagaattcatcgctattttgatattttcaaagagtttcattcatagcgtccccttgtgtcaatctatcttcaacgagtcgtccatctcttacaacgaccgtccgatttgtatacgcagctatttcttcttcatgggtaacaagcacaatcgttgttccttcctcattcagcttcgtaaactgttccatgattgagaagcttgtttttgagtcaagagcgcctgtcggttcatctgctaagataagctgcggcttattgacaattgcacgggcaattgccaccctttgcttttgccctcccgacaactcgcttggcatgtgtttcattcggtctgacaaaccaaccttttcaagtgccatctctgcacgttcttttctttccttttgactgataccagcgtaaatcatcggaagctcaacattacgccttgcatttaacctcggcagcagatgaaattgctgaaagacaaatccaatgaattgatttcgaatcactgcgaggtcttgatcctttgctgctgacagctctctttcttgaaaatgatattgtcctgtagttggccggtctaaacagccaatgatattcattaacgtcgattttccagagccggaggggcccataatggacatatactcgcctttttcaatgacaagatcgatctcacttaatacatcaaatgattcctcggcaacctcatagctttttgtcacgtttgaaagctgaatcattcagcattcacttccattccgtcatacatgtcatctgatggatgagaaatgatttgatcctctgctacgacaccttttgtcacctcaagatcatgacctgacgtttcccctagcaccacttttacttttttaagtacattctttttgacaacataaacgtattgtccatcatcctctttttttacagctgattcaggaatcgttagggcttgacgcttatctgtttcaatttccatgatcattttaaaaccaggttttgcttcaggtttttttccctttatttcgatttcaactggatattgcaccgtttgatcacctgcaggtgtttcggatgctgcctgagcaggtacaacccccacttttttcacgactccttgccagctctctccgcgaatgacatcagacgttatctttactttttgtttcttttttacttttatggcgtcatactcagaaatcaatcctcgcacaaccatttttttctcattgccaatatgaatgatcggctgcctctcttccggctttcctgccccttcttcttgctcaatggaaatcactgtaccatcaattttactatgtacgattaaatcttctatttgtgcttttactttttcttggctgatctctgcttgtttttgttctaattcagccgctttcagctctaattcaagctggtctcgctcgtttctagaattggtggcggattcgccttcttgttttttgtctaattcgctcaatctattttgtaattgttcgcgttttaaagtactggattcagccgcaagagcttgctgctcttcttcaagctccagctctctattttcatatgtaagaagcggcgttccaggctttaccttttctccttcttttacagaaattcccttcaagtgtcccttttcctcttctgcataaataaactgttcttcaaagaatgaaagtgtccctggcgtcatcaccttagtggtgatttctttttgcgagggttttactgttttgatcgctgctgttgaagcaggctttgcttgatttttcgcaatgttaaagccaataaatagaccgataacaataataaaaatggatccgatgatgattttctttctcataaagacattctacccccagcttactgatatggtgattgcagttcctacatattgaaaaatgatagataagagataaaagactcctataatggtccaagctattcttggcgatatatggccaactttcatcaataaaaagcctgttaaaacaaggttccagatcacaaatagatcaatattggcaagcacagcatgccatggaccagacgtttgaatgagtgcatttaatgaggtgattgtgatgttttttggtacatggaacagaatgatggacagatgagaaataatcgtaccaacgatcgtaactggtgtaataaacaggaccgctgaaaacagctgctgaaacgatgcatcaccctttgctaaaaaaacgatgaacttatagattgcagcattaaccacaagcccgagaagtagaccaattagcgtcaccacataaacgaccgataccggcaagcttaaatctgcccacattccttcattcaccagctctgacaaataagtcacaatcactgttaaaagaagtacgcaggataaaggccaccaaaccaccggattttcccatactcttttcaggtgctccgaaggccttgtgctcactccaatgatcgtaggcttttgcatattttctttcatcaaatgtcatcctctctatgtcatgcaagtatgcaaacgcacatgctctctcttattctttctattttatcaaaagattgccaataagtgatggatgatttgattttcttattttcattgagggaaaaattatctattattctattatcatggatgaaatcctccaaatgacaccatgactagaccatattcatatcaataaataaaggtttttctgacctaaaaacattttatcaaaaaaacacatgtctttcggaataaatatccttttcctttgaattcggatggtctttgagagacacaacaattttttgttaaaataatcctagtaatttcaacaaatcccggctttataggactacgattggtttcttttatagaacaaatgagcctttagtaacaatactttcatattaaaaaattaaaaatataatgattttacttgatcaaaagttattttttcatataatgtaaaatagaggtaggttaaatgatagtggaaatggagtcaagtgaatgttaagagaaaaattgaaaacgcaattgattttactttatgaaaaggaacaagaagcatggcaatactttcgaaaggaaagagaactgatttatcatgagctcaaattacttgatatgaaagaaagcagaccctcaaatgacaaaatatactacgctgctagatgtgtagatattattaaagagaaaaagggaagcattgtgagcacaaaagaattaaaagaacaacttcaagcccagacagatttcaatgtgagacgaattagcgaattgtatgatctaatacagcagctcgatcctcacatttctaaagcacgaaggggatgttttatttacgaagatcacacccaaatacctctacaatcttttcacacataaaaaattggttacagccgctggccataaccaaatcctctaatatctattatccaccgcttacaggaggaatgaatgcaacagtgtccccgctacacacttcagcgtttcccctcgtatatcgttcgttgactgcaaccatcacattttgtgcagcatcaacaccatatacctcctgtaattctaatttaatctcatcaaccgttgttcgatctttttgaatgatgatttgttgtttaccggccttctcagcaaggccggcgaacaataatacactaatcaacctgatcaccttctttctttgcaagttgaagatcactaggtttcccctctggatatgaaactgtttcaagctgatcacctatccaggcttccccgtcttcccaatattcttttttccaaatcggcacaatttccttaattcgctcaatggcatattcgttcgcttcgtatgcagctttcctatgaggagatgaaacggctatcgcaactgcaatatccgttatatcaagtgtcccgatcctatgcataatggcagcttcagtatcaggccaccgttttttgatttcttgtccaatttgacttagcatgctttctgccattggtatgtaagcttcataagttaagcgcagcgttttcttaccgtttgtccactctctgaccgtcccgataaacgtcgtaatggcccctgccttccgctttgtcacatgctgaatcaattcattcacatcaatcggcatttttgttattttaaaaagttcactcaaatagagccgcctcccttcaataagttataacaaaatgagttcgcatccttttcaaaggctgaaaacactggaaaagaataattttcggctaactgaaactcttgagaaaaataaatagctgcttgtatattggaaagtgttgaaagttcaatgagctcctcttcattcttcgcacaaacgattttgcggtatggtgcctgtttatacccttctatcaagaccgcgtctaatggaagatgctcacacatattgagcaattgctctaacgtaatgtgctgcattgaaaagtgaaattcaccctctccttctacgccagcggcaaatgcacctgccccgacatatcgatcagtgtctttttctttcaaaagacgatctggtttaccgccatgtccatggtgtttaaagcaacctagcttcagcccatcaagtacagccagctgacagagcttttcaatcaacgacgtcttgccgctgttttgatagccgaccacctgtaatatacttaatgtgtcatccagcatggggaaccctcgccttcgtgctgaaacagcagaacatgcacctgatcaccggccttaaaacctcttgttccacctggcagcacgatgaaacagttagcctctgcaattgaggttacggcacttgatttatcgagacctgttggggttacactgagctgactgcccgtgaattgaagtgctgctctgacaaatcgagtgaacggattggcttttggaaaatcgtgtgtcagcttcgcctcagcaaaatcggggaacggctgtttcttcaaagaccatttatagatcatcggtttcacaaataattcaaagccaacaaaacaggcagcaggatttcctgacaggccaaagagcagttgaccatttggcattgcagcaaccgttgtcacacttccaggtctcatagccactttattaaatagcacctgagctccaagcttctcataaatcgcggggagaaagtcaaaatcacctactgaaactccgcctgttgtgattaagtagtctaccttgcttaaagctgctttgactgcatgaaagcttttgtcaaaatcatcggacacaccgcctaaatcaagcggctctcccccagccttaagggtctgggcataaaccatactaaggttactgtttctaatcttcccgtccaccatcgcatcactcacttgaagaagctctgtacctgttgagatgatgccgatcactggctttttgacaactgggactaccgcatatccaaatgtcgccaatagggccgtaacgcccggagttactttggttccttttttaagcatcacattcccttcaagtacctcttctccttgacgagaaatattgtccccttttttcagcggtcttttaagtgacatatataatttgccctctttttcataggacttagtcagctcaagcatgatgacgacatttgctccatccgggatttttgctcctgtcatgatacggatggcttgaaagggaccgatggtttttgctgagaccactcctgccccaatgtgatcaatgacctcaaattcaatcggatgctcgcttgacgcttctattgtatcttctgcccgcagtgcaaaaccatcatacggggaccgatcaaatgcaggcacatcatgatctgccaaaatgtcttctgcaatgaacctttcaaggctatttcttaagggcacccattcttgttctccatgcttttcatattgatggactttctgaatggcttcttgtactggaattggctgacgtctttccatcacacttcactcctatatccctagcagttttgctagtaatgaattggctgctttttcatcatttgttccatggattaatgcacgtccacctttgaaaaagacaatacgataaggctcatagcggacatggattaagaagtcattcacttccacctcacaaatagatgacagccgctctttcacatgctgaaatgatagattagctaaatccttagatacgacttgaactgtatcccgcccgcaaagaatcgtcgtttttttacgctgctcgtgtaaataaggataggttctatctttgccgcaagatggacagtccttctgcttagtaagagacaaatccattttaaacgttgtcgcctgccaaagatcaaatgtgacaaatttccgttcgatttgatcttcatgtcctgttaaatattttagcgcctctgtttgctgataagcagaaaccatctgaactgctggagaaataatccccgctgtatcacacgtcaagccgccaacaggcagttctgtaaagacacacgataaacacggcgttttatccggcaaaatggtcatatacatcccctgactgctcacacaagcaccatatatccacggcgtcttcgtttcctgcgataaatcattcataaccattctcgtctcaaaattatccgtcgcatcaatgacaatatttgcactgtgaaataacggtcttaacagctcaacccctgcatcttcaatcagggcgtgtatggtcacttcatgattgatctcttggagacgtttttttgccgcagctgcttttggcacatgtgcctttgcatcatgttctgtgtacagctgctgccgctgtaaatttgaaaattctacataatcacgatcgacaatcgtcaacgtgccgatcccagaccggacaagcccttccgcagaggccgttccaagtgcacccgctccaacaattaacacatgactgtcagcaagcgcacgctgacccttttccccaaccggagggaacaaaatttgtcttgaatatcggtcattcaatgctgctctctcctcaccatttttatgtatcatatcataccgttttcaggtaaatcgcttcttttattgatatttcgaaattcgtttggtgttacgttcagttcctcctctggaacgatacgcaccttcagcctttgaagtaactctttcatggctaattgattctcttttaaacacgcatcaatggacggcagacagcggcggtgataaagtgcaaataaaggctgtaaccttccctgaacaagtgggataattgcatctacgttctcgctgcaataggacgataatgcttcggcggtctctctccggatgaaaggcatgtcacatgccgtcactaaataccatgctgcttctttcttttgcatcgccgtatagatgccggcaagcggcccgcatccgcgcatctgttcatcatccaaccacacttctcgttcacctctttctttaaaaaaggtcagaagtgttgaatggctgatgatcaccatctgtcctttcaaaagctgctttttcacatgctcatatagtggttttccttgatacatataacttgcctttggctctccaaaacgtctcgatgctcctccagctaaaatgacattgactacgtccatccgctcaccctcctttgatatggttgttctaatcactctcatttcgcatactttattggtaacatgaataaggagggtctatcgatgaacaggcgccatgcttctcccctattccatgatctatctcaagagaatttatacttaaaagcagaaacagccaaatatcaacaaatgatctctgagttacagtcctcatatacgtattctaaaaacaagaagttaactcaagaatatcacgagatgaaaaaggattacacgcaattaaagcaacaattggatgaattgaccattgatcaagatcatgcagcctcaaaaatacaggatctttcctacagcaaatctgaattattacataaaatagtccttcttcatgaaatgctccaaaaagaaacctttcatagaaggaaagaaacggaagacaaacaccggctgcatttaaaagtcatcaaatataaagaaatctctcaacaattaaatgaacggatgcaggatcaagataaacggcttgcaaaagaggagaaaaaaggaaatactttatccgctgtgattgagaaactgcagcaaacattaagtcataaaaacgcagagctcaatctattacaggaaggcgttagacacctacaagagcggttttatgaaacacaagagaaattactgcaaatcgaaaaagcaaaggaagcgattttttatgaaacgctcataagctatcaaaagcagttagccgaaagcgaggaatggatcgcatctcattttgctgatattgaccagtcagcccaaacaaattcacagccattctcacgagacagcatcctggaaacaacggaagaaatcgaacccatcttgaaaaagctgaacgaacaagttcaaacgctacaagcacaagtcgatgcggtgcaccaaaatggagatgtcatgacagtgaagattgatggcttcaaaaaacagcgtgatcgcctgtcaaaggaacgaaaaattgtctatacagttgatcaaaaaaagtaattatcgcaataaaaaaaactgctggcatgacgtcagcagtttcttttttatttattcgtcttctgtttgaatatcgccttctaaaatatactgtccgcgatatggctttttcacttcaggatacattttaattaagctttgcataaacgttgtcatatttggaatttcaagaccgctctctttttcaatttctttttgaagttcagagcttttaatcgctgcattatgacgctttaacgttttaatcgcagcttcacgaagcttagctgcctttgaaccagggcgagctgtgcctcttctgcgtcttgtagatccttcaggaatacctacaggtgcaccgtttagctgtcctgttcctaaagttgatgcagaatttgattgtgattgtgcaggcggctggtagcttctcatttcttgtgcagccagttcagctaatacaggcagtgaatccgtttttctttctgcacgcacttctttttttgtatctgacactagacctgttccttgacggtctaattctcttaattttgcataaatcgcatctcgctcaatttgatattcacggatgacctttacttctgcttcgtttaattgttccaatcgtaatcgtaacgcttccctctcattaaacaatggatttccccctcatcatataaaaaatattctatagtaaatattagattagaaaactaattttatcaactatttttttatcattttacagtttgttatcagataggtattttcaactaaaattttgccaaagaggaacaatcggcatccatttcattgccactaaaggcttttgacaaaccttaaaatattgtaaaaaatttgaataaacacttatactacttgatttacatcgttatttaccaaactgaaatttcttttgtgcaaaaacgttctgaatagtaaaaagttaaaatctttacattttcatttcaaaacaaaaatgtaaataggtcgttatacctttttgtttcaggaatattttttaataaactccctcaatttctcttttcttaagaaggacaagtccattccgtgcaataggtcgcctatttttgtccatgaaaaaacccccaattatgggggaaagcctattctgcagccttttcagactcagaaagcactcgattgacacgtttctcaagcattttcattccgcttccgccagcttggaagtggcgcagagcacctgttttatcaaacacataatatgctggtacatattcattttcaaaggcttctgttagtttatgatcgctatccacaaaaattggctgggtgatttcatgctctttcgcaacttccttgatcttctccagatttaggtcatcctctgaacgcggcatatgaacggctatcacgtttagttgatccttgtattcatcacggaattgattgacttgaggcattgcctctttacaaagatgacagctgactgaccagaaatgaatcaatgttggtttctcaccaatcaaatcttcttttgttacttctccatttaaccattcttttgcaccagttagttctggcattggttgacgtaatttcattatgaagcgcctccatccattgtatgtgtcgaaacaaaaaggtctaacatcagttagaccctcctgtttcttcagttatcaattaaagtgttttttgaccaggcttccagttcgctgggcaaagtccaccagtttgtaatgcttgaagaacacgtaatgtctcatctacatcacgaccgatattgttgtggaatactgtttgatattgaagttcgccttctgggttgataatgtatagaccgcgaagtgcgattccttcttcttcaattaaaacgccgtattctctagatactgtgtggtttgtgtcagcagctagcggatatttcaattcacctagaccattgtctttacggtctgtgttgatccaagcaagatgcgtatggattgtatcagtcgatacaccaatgatttcagcatctaaatcttcgaactcatcataacgatcgctcattgctgtaatttcagttgggcaaacaaatgtgaaatccattgggtagaagaaaagaactgtccatttgtcattcttcatgttttcttctagactcactttaccaaattccttgttagcaagtactgcttccatttcaaaacgtggagcttgttttcctacaaaacgctctgccatatgtaaatccctccaaaaataatatctttatacagacttctaagctgtatataaaatgagaatcaaaagttgaaattctcatttagttaataacttcacaattacaattataatacttaagcggtttttagtcaatattaattaataataaatttaattaacgatttgtcacaatctcttactccacttaacgaaagtttaacatgtcttgcagaagggaacaaatgattagcttctctattagagcatacatagaaaggttttgaagatcatgaaagcatttgaacaagtagattgggtttccattatcctgaatagcagtatgattttgctaaagctcatcgctattttcgcgatttattttatcatcagagccatcggaaataagatgattaagcgtgcttattctacattctctgaaaagcatgatgtctctttatcaagagctcaaacgctgcaaagtcttacgttaaatattttcgcctacttattgatttttattctagtcgtcatgatcctcgacttatttcattataacccgaccgcattgttagctggtgcaggcgtcgtggggcttgcgatcggctttggcgctcaaggactagtgagtgatattgtgacaggattctttatcctattagagaaacaattcgatgtgggagaatatataacagttgctggttttgatgggatcgtagaacaaattggacttaggaccacgcagcttcgaagttttgacggcacccttcattttattccaaatcgaagcatattgaacgtgagcaaccattcaagagggactatgcaggcactcgttgatatcgagctgtctccagaagagaatgtggatcaaatgattacagcccttcaagcggcgtgtgatgaggtacgagaggacattcctcaaattatcgaaggacctcaagttgtcggggtggaggcgttcggatcctcttcccttgtactgcgcatcattgcaaaaactgaaacaatggagcaatggcgggtagaacgtattttgcgcaaaaaaatgaaagaagtactcgatatagaaaaagagcaaaaagaaccgggatgataagctaccggttctttttcttgtttgttttattgaacacgctgttctacttcttgacaaatttcatcagccgtcataccagacgcggtaatcacagatgcctttgtcgttgtgtctgaaatgccaagaacatttgaatctagtcctgtgacaacatagcagtcacactgatccatttgctgttcattttgaatacgtacgacgtcataccctttttgcttcagtagttcttctacatcggataaagatggttctacaccaatttttgtcataatcaagaacacctcctgttcataaggtgtacaggaggcagcttgattattcattcacctgcttgctttttgaaataagccgtcataacgtttacagctgtttctatcgctttttcatcaggcatgagttttgaatgatgcaggccatattctgaatcgacccctaaccaaaacataaatccagggtactttttcagcatgtagccaaaatcttctcctgtcatggcctctctgcattcaaccacattcgcaagcccttctccagcaacatatgacataaattcctctgtcagttcctttgaattatccacttcgtaataagatgaagggtatcgcacggttaccttgcattcgtagccaatttcaatcccttttgctagtgcttcaattcgctttctcactttttccatagactctggtgaaagtgtacgaatggtgccatcaagctttgcatgctgcgcaatgatattttgagccgttcccccggtaatcgtgccaatcgtaatgaccgcactatcaagaggatcgacattacgagaaataaccgattgcagttgacctacaagtgcactcgcagccacaaccatatcattcgctaaatgagggtaagcagcgtgtccgccttttccttcaagatctatcacaagctcactcgtattggcaaaaagcagccctggctttgtggctatcgttccgacaggatattcaggtgcaatatgcagtgctgtaataaaatctggcgtccactttttcagcacatcacttgtaagcatcggttcagctccgcctggaccttcttctgccggctggaacataaataatagatcttctttgattggctcatgaacgaaatgatcaatgaccccaagtgcgatggtcatatgaaggtcatgtccacacgcatgcatcttcccttcatgtactgattgaaatggataccctgtgtcctcaggaatagacaggccgtccatatctgcacgatacgcaaatacgcgctcaggatttgttccctttactttgacaaaaagtccagttcgccatgtttctatctcaactcgatcttttgaataagcaccaagatgcttgatgaggtatgcttgtgttttgaattccttaaaaccaagctcagggatttgatgtaaatctcttcgaatggatatcaattgctcacgatttaacaagtgaattcgcttcctttcctctatacgaataagacgtggatatatatccacgtctatgtcttcagctgcgaattatatgaattaaagctgacgcagttcttgtttgatttctgttttaccttttgttttttcatcaatgtctttaattttctttgcaggtgtacctgctacaactgtgtaaggctctacatcgttcacaacgatcgcacctgcagctacaactgcacctttaccaattgtcacaccttctagaacaacagcgttcgcaccgatgacaacatcatcttctacgacaactggtttagcagatggcggctcaatgacacctgcaagaacagatccagcaccgatatgacagttcttacctactgtcgcacggccgccaagcaccacgttcatgtcaatcatcgtaccttcgccgatcacagaaccgatattaatagaagcccccatcatgatgactgcattatcaccaatttcaacttggtcacgaatgatcgcacctggctcaatacgtgctttaatgttctttaaatctaacatcggaattgcagagttgcggcggtcattttccacgacaacatcttcaattttgtctttgttcgtttctaacgctttttgaatgtcgctccactcaccgaaaacaactccagtgtttcctgtgatgaacgtttttgcatgttcaccaaactcaatgccttctaaatcacctttgatatagactttgacaggtgttgattttgtactattttgaataaatgaaataatttcattagcgtccatttgtttcatgtatgtatgtcctcctcttaatttatacttcattactgtaccaaaggagagttttaatgacaagtgaaagagttgactcttcaatggaaaataaaacaagcgggactgattaccccgcttcctgctggtgaagatgaacaaattgtttaccaaaagaaatcaatttctcttcttcttctccttctggatttagctcgatcttgactgatggcaggacaatgtccccgccaagttccttcactttttcttcgattagatcaacagctccgcaaaaatgctcataagatgtatccccggaaccgaatacagcaaatgcttttcccgttaaatcaagctcttccatttcttcatataaatcaataaaatcatcaggaaggtcaccatctccccatgtgtacgcacctaacataatgtgcgtgtaatcattgagaagttctgcatcaatatccatcgcttcatgacggtccacgccagctcctgcttctgttattcctttttcaattagatccgccatcgcttctgtattcccagacatcgtggcatacaccagtaaaaccttttctgtcactttttcttcctccttatcaatgaatcaatgccggctcctcatatggccttacaaacttgctttcatataaaccagcacagaaaaagttttcattttgattggctacacgaaaaccgtgtcctttgatcgtatcaaaccatttgagctctttttgctctatatcaagctgatacactttagaaaatccgtattcgtcttgtgaagtagttacatacacaatgccattatcctctgacacatccaaaaatgattcttctctagcaaaggcttgtgattgaatatcatgcagcatattggtatgtaaatctaaaatttgaacagatccctttttgcctttttttgatcccaatgcgcaaacaagcagatgctcttgacagagcagcatagaagctgtcatccggtgctcctctctgtttagaaggaaaacctgttcactctccaagtcatacacccatactcctccgtgaacctcatgaatctgtgttccaatataaaggtgatcacctgcagcacataaggaacgaatgacaggcggatggttcacatgagcaaacggcttcataatttcccaggaaatcccgaaatcatttgacacatatatactatgttttccatgtgcacacacaaacccgtcttcgcgtcctgtaatcgaccaaacgactgcatttgttggaaatgatgatagcgcccatgtatgaccttcatctcctgatctaatcactgtgccattttcaccaacaccgaataaataaggtccaatatagctgatggcatgaattttatgcttgagcttaaacagttgctgccatccgctctccacactatagtgaaagataccttcacgttttacagcaacaaagtatccaccgtttttagaggcagcaacggccgtcgctcctttatgaaacatggttttcaactcgtttcacagatagcgccgcccatgttaaaaagcttgtcgcaaattcctgacagcacgccacatcctcatctgtatcaggtgcaagctccattttcaatgtttcaggaaacacagatgcaccggttgatttgagcatgtcatgaaatgtatggacagcctcacaaaacttcgggtaactgtaatctcctgatccgaacacagctgctttgatgtcacatagttcaagcgcagaaacctcttcataaaaatcctctgcttcataaggtaaatcgccatcaccccatgtataagaaccgatgaacacataatcgtatgaagaaagatcctctgcgcttgtatcatcaaattccatcatctcagtatcgatcccttttccttctagtgtttgctttataatcgctgccatatcttctgtattaccagacatactcgcaaatgcaattagtgctttcatctatcggtcacctcatctaaatgataatcattttcaattattatatgtacactttaaatgataatgattttcattgtcaaatgatttcataaaaaagctttgaccaatcaatactctaacccaatgaaaaacccgctcaatccaattggaaggcgggtttttcgtatcgaagagatcatcggttcctcattcgttcgtttcatctattcgaataaaatatggaccataatccgtttcgtgcgtcatcacaaatgtccatttttcattccaatccatcacatacatatcgttataatccatattattagactgatatggtaaatcattgattaaaagagagctagcattttcgaaaagatacgcctcgtcaacaaattgataaaaaacagtacacttatcctttgattgttgaagaaatgcgtctatcgcctcagccttttcaaggcatgtaaccattccaaaactgcataaatgccataaaaaatcatctactgatatatcgttttgttctttaactgaaagatgactagcaaaacgttcacgccacctggcgcgcaaatgatctccccattcaggtttgttcattttgattaattgattgtttttcataaaatcgaggtctcctctatgattcgctccatctatctattgctttgatatgcgtacaataagtaaattgaatcaagctgattatttacctaaaaaaagcaccttcctcttccaagaaggtgcttacaccgcatcactttcaagcatttctttgaccacaccaacaaatgcttgcacttgttttaattgaaaagaagcttcatagcctagcagccatgtgtcacgtccgatttgttctccattcacgtcaacaagcggtgttttatgaacacttttttcgtggtcgtataaggtgaccgaaggcaaaatggcgtagccgatgccgtggtaggccatctgtttacacgtctcaatctggtccactagaatcgtctgctttggagacactttgaatttttgatgccaccagtgctggatttcctgataatacgtgctgtcgcttttaaattgaataaacgggcgttctgtctcgattaactcgtccacgtccttgataacagaatcgactaaatataaatgatctgtcatcaaatattcctttgttcccttccaatcagggtttccgcgaatgatcccaatgtgcacatggtcctcatataagcttttgagcatttcactactccagccggtcacaagtgataccttcgcatttgggtacttttcgacataccgctttaacactttcggcagccagtgctgtccaataatggaggccaccgcaagctttagtgtaccgtgaatttccccttcaagttcatcgattctctctctcactcgatcttgctcaaccgtcacctcttttgcaaattgaatgatctgttcacctgccgaagttacggtgagccctttctgagaacgaaaaaagattttggtaccccactctttttcgatcgtctgcaatctttgggataaagcaggctgagagacaaagagccgctccgaagcctttctcatattcaattcttcacttagcacaacaagcatatgtaactcttgaagctgcatgggcgtcccctttctctctataagtttttcttattccatatggtcattatataaattatagcttatgaaggcaaaaaaaataagctgggcttcagctcattttttcgcggcatgaatcacttcatttaagcgctttaatacaacacgtcgtgtaaatattccttcaaagacttgctcctcatttacgacacaaacaaatccattattcgttacagcgtgaacgccttttagcacaggatccgttgttttaagccttgggatatcagtgagcataacttcttctaccttcagttggtccagcttttcgaattcaattcgttctaaaccaaagatcttatccataatcatattcgttccaattaacccatgcaggtgatacgaaggatctaatactggaatggctgtatatcctgtttttgtaaggaccaatagggcatgctcaagattatttccaatttgaacatgtgccactttatctgcatcaatcatatgctcagctactgtggactcaagcaattgagttggttctatctctatcatgtttcttcgaccccttttctctcaatcatcaatcatacattcccctttaccattaagcataaactaaaacgaaatttgtcgaaagattttttctgcataaaaaagatactcagctcccgagtatctaatagaatgttcaatcaatattaattctcaaaccttactctgtcatacaatgtgatcaattgcttatacgtattgtcatcgacattttttgttccacattctatatcattgatctcactgcttagtaattcgacagcatattcctgattcagcaatacgtttaataatagctttttctcttcttcattaaaacgattttcgatgacgctcatccaacatcaggccccctgtttcatatatgcttttatattgattagcaggcttttgaatgtctgcttcctctctatacagctagaataaggaactagaatcgaatcgtcaaccgcacgtttcgacaaggtttggagaaaaatgacggaatttattttgtgtatcgattggcatagcaaaatgctgcgtatgagtcgggttttattttagcttcaattcccatagctgtgatcattccggtcatttcctgaatcagctcttttgtacttccttttttgccaatatctagatgagcttcaaaacggaggtctgccccttcctcagcaaagggaagaagcaaatccatcagttctgttaaaggcccctcaaggatgtctgcacataccttttggctaaacgctgtctctaatgaaattttttctctaaggctttgcacaggcctgctgatcacttgttgcgtaagacagccccaagcccctttgccaatccggtggagatgaattgcagtcataaatcttgtgacattttgattgacctgcgagtccgtaccaattgataacacataggcggatctagggtcttttcgaataaagtctttcattctcatgacgacatcagaaaacgctaaatgatcttcagaaagattgtagtaaaaagaatcactcacagaaaggaactcctttttaatggtctcttatccgaatattgcgctgaatgatcatcttccttttgcttatcacctatgaagtgtatgcttccgcaatcaacaaaggaattcttagaaaaaacatttcatacgattcagcttaggattgtagaagctcaaaaatctcaatcgaaatcatatcaatgttgtcaaatgggaaagtatttggcttatccccttgttgaaaaacagtcaattcaaacgtttgattcttttcgaaatacttaacactacagattttctcaccgttcacttcgaaataacgctgtgccggttcgtttgcagcttctgctgtctcttgaagactttgcagccttgtaatgatacccattaattgtgacattctaaaaaaagactcctttcaaaaaaacaactcaagatgaacccgtattgattatacacaagtcctacaaagcatcataccataaagtgttctcagatgatatttttcctcttgaattcaaaaaaagaaaaagaatctgtttttttagtttgagtcttttttctgatctcatgcaccatgtttttataaacccgcagatctcatcagccgtttggcaatttcgtcaaaatcctctttggaaatgcctggggcaaactcttccggtaattctctataatctggcacaggtgctccttgcggggttccctcaatcactgtgagcggttttccatcaatcggatggctgcctttccaaatcttattgatatccttgtaatccgtatcactaaatgtgtacagttttgtatgaatattttggtcttcaaatttccttgctgaatcaaagtatttgttgtcgaggtttgggatcgggagcattttccctacatctactcctgtagctacctcaagcgcctttgcatatgccacaacatgcacaccgccccgcacaagtaaataaccgatcatctctcttgctgtaggatgatctgtcatttcatatacgcgcattttgtgcgtacgagccccgcattcaaggaagaaattatgaaggaggtcaagaatcaggtttccgcttgagaacacattctctccggtccaaggttttgccatggaatcaaacggatagcctgtttgagccgtttgaataaaatgctgtgtatttcgtttatcgacagccgctttcatcggtgtcgtatctggatctccgccatgggtggtccctgtaatcatgagattcacagctgtggtcacaagttctacatgaccgaattcttcagccgtaatactggatacgaggtcataaaacggtttgagttttcgttttcctctaaagttaaaggattgaaacatgtaattatttaatgtggacatttcaccgaattttccgccgagtaattcttgcacagcagcagcaccatttgcatctgggtgatctggccttggcaaatcaatcagcagccgcttgtcacgtttgatcatgacgttccctcctaccgtctaactgtcatcacttaagatgtatggagtgattgggctgtcctatgcatgaggtgaagatgaaaagcacaaaaaaaacttggcgggggtagcgccaagttttttggatcttgatctgatagaggggttggggaacagagagtagcttctctctataactaaatgataatgattatcagtttcattgtcaaccattttttatttctttttttcaatcaaaaaaagcagcctaaaaggctgcttagattgttaataaatggctaatataatcttcactctgtgcgtttaaattaatccatcctgctcatataaataggcatacggaagatctataaataaatacatatctccctctaacgggtaagaaaacgtacgtatcctctcaccagtttctaaatcgctatatatatcactgaaaaatcctttcccgctcattctcatttggagaatattcgctaggaaataaggacgccagctccagtttttctcaatatattcaggctgaaacagccattctttttcttttttaaacacatttccagtgatttgaaagccctcttcattacacatatatatccgaaagctgcaatccgttaattctaatgccagcttttggatgagttcatcatttgtactgcatgatttttttaaggtcgtgacagcttggtgaattcgtttataaaatgtttcagaatgttcgtagacagtttgtagtttctttttctcatgagcaataaattgctggaattcttctctcagctgatcttttcgtttattacggtcgattaattccgccgccggctcgtgaagatagaacccttgaaagtatctgccgccatttctccaagcatattgcagctgaaaatttgcttcaatgtcttcataaattaaagccgcccctatttttctcgcaagcaatgaaatgctgtacaagacatattcataggaaggtgaaggagccgatgctcttaatgcgtgtaaatctatttttaatagatcgggtgagagcaaggcaatccggtcaagattgctgctttcttttccaatattcgagatggcgattttaataccatatgtacgaaaatacgttaacgtatggtaaagctgttcaatatcgccgctaaacgtatgctctgtaaattcgataacaaatcgattaagctgaatgcctcttgcttcatattgcttcaagagttctaaaaagctttcaccatgatcaagcatcaggatattggcatcatggttaataaaaatgagcaaatcatcatctgctgttgtgaaaagatcaagtgcttgcgtcagtactttatgatctacttctactttatattcgtcaggaatagatgaatccgtaaagaaggagcctaggctaactgtttcagactcgagcttcattcttcctaaaatctcatagcctatcactttttgctcttccgcactgaatatcgcttgatagtgcgggaaaacatcttcaatattcgttaaaatatccaatggatcgaccattttcatcacctgcttctctctttgtgtgattataacacatcaaaagcaggtcttacatcgtcattcaaaatggggattggttgagccattgccctccatccattgtaatacaatctccatttatataagacgcttgttcagataataaaaagcttgcaagcgctgcaatttcctctggtgtgcccagtctgccaagaggaacactatctaatgttctttgcgctgcctcttccgattcccatagtttatccgcaccgcctgttctctcgattggacctggcgcgatagcattgacgcgaattcgatattgctttccccattccactgcaagcgttcgagtgagagataaaacacctgcctttgctgccgctgaatgcgccacacctacaccagcaccccatgcataggtcgccaccatattgaccatacttccgcttttcttttgacgaatccagtaattgcccactgcatgactgcaaaaaaatgttccatttaatacaatatcaatgacagccttccagccgttaggagatagtttttctgctggaactaaaaagtttcctgcagcattgttaatgagagcatcaacatcgccaaacgtatctacggcaaacttgaccatttgatcagcatcttctgggtttcgcacatccatttggaagtaagcgatcgagccgccattttgttttatttcatttgccgctttttctaacgtttcttctgttcttccagtaatcacaacattccagccttcatgtgccaaatggacagccatcgccttccccattccgcttgatcctcctgtgacaatcactgtttgtttcgtcatttgttctccccctctgtagttttgaatgactattcattcattattttctatcatatcacgattgaccctagatgcaccatatgggagattctttaaatatgatgctatacttaattttatttataaaggagtcttatatgaagcaactttctcggagacagtttttaaaaggagcagctggcgcgagcattctcggttttttagctacaacatgtgggtacgggtatgccagatacatcgaaccacgcatgatcgataccgtgtcaataaccattcgggatgctcagcttccagcttcatttgaccagtttaaaatcgctcaatttagtgatgttcatttaagtgatacatttcctgcgaaggaattagaatccgtcgtccagcaaatcaacgctgagtctccagacctcattgtattcacaggggatctcgttgattttcaagcatcgattgaagagcatgaaaaagcgaaagcctatttgactaagctccatgccccgtttggtatgctcgcgatatgcggtaatcatgactacggaccatttggtattgatctttatgagaacacgatgaaagcttgcggctttacaatatgtaaaaatgatgtgtttccattagaaaaagaaggggcgcatattcagattgctactatggatgacttgatgatgagtgtgccggattatgacctaatgaagcgggaagtatcatctgatttatttaccttgctgctcgtacatgagcctgatgcagcattggagttgaattcaatccccattaacttgcagctttctggacatacccatggcggacaggtgcagcttcctttctatggacccattctcacagcacctttcggccatacatatgtggaaggtttatacggaagttatcagcaccgcatctatgtcaaccgcggccttgggacaacaagactgccgcttcgattcttagccaaacctgaattaacctttttcaccctctcttctcgcatttagacagaagccaaaccgcttctttttgcatatagataatcaaagatctttctcatgacaaatgttaggagaaaccttccttagcctgattccgtccatatatatatcaagtgacgggcatcatggctgcttttatttgagcaaaaggagtgtcctttggtgctgcgatatacggtaaaacgcggagaaacgctttcttctatagcgcttgattttcgaacaacaacagatgccttaaaggctgcaaacccttcacttcaaggtcaagaaccggtacaaaatgaggtcatcatcattcctggtctgcccgatcctaatacgatcccttaccgcatctctgtttcaatttctaggaaacgtctcgtcttgttttctggatcagagctgattcgatcgtatccgattgcaacaggaagaattttaaatatgacgccgacaggttcttattatattgtgaacagacagccaaacccaggaggtccctttggcgcctattggctgagcctctcgaaagttcattacggcatccacggtacgaataacccctcttcaattggtaaagctgtgtctagagggtgcattcgtatgtataatcagaatgtcatcgaacttgcttcactcgttccaaatggaacacctgtgaccattagccagtaggagaaatcaattgtatgaatgcttaaaattttatatgatataaagtgggatcttcaggttaaggagcgtatttatggatatttttaaaaacagaaattttgttcgtctcttttttgcagcacttgcttcgcaaatggggacaacagtaggcaatatggcgtttgccttttatttgctcgatcattttagtcatcagcccgcctatgccacattagcagagctcatgtattcacttccaacgatctttgtcttttttatggtcggtgtcgtagcagatcgttttgatcgtaaaaaagtcgcagagaattgcgattggatacgagctgggctgacgattgttttattcatcgttatttatttcaattcacttcctcttattttcttgatcttatttatacgaagtgccattacgaagttcttctatccagctgaagcctctctcgttcaggcgattttaaataaagatcaatatgcaaaagccgctggtttaaatcaaatgctgtttagtttattcatggtatttggtgttggaatcggtgcgattatgtataagacaattggacttcacggagccattaccattgatttgatcagttttattgtgtcaggcatcctgattcgttcatgtaacattccaattgaagcacgtcagccaaatggacaagcaggctggagaggtatgaccattaaaacgtctctaaaagattttaaagaaggcattctttacattataaaaaataaattattggcttctttaattttcggcttttttgtttttggtctagtcaatggcgcatttgccgtacttccgatgtttacaatgaaatatggtctttcaccggatcattttgaactgcatacatccttctttacaatcgcgatcggtgcaggcctgcttgttggcagcttaatgggctctgttctcgctaagaaagtaaagatgcaatatctcatgtcacttccaattttggttgcaggcattctgatttttgtacttggttccacccatacactatggttgttttatgtcacatcatttgtcattggtacatgcattggaccggtcaacattgtcattggcggctggctgccgagaatcgtccaccctcgtctgatgggacgtgtgtcaggctgggttgatccacttaccatgtttgctcaatccatgacattaggtttgattgcggtactatttccaaaactcattacaaacgtttcttatatttattacggaatgggcgttattattttactcgttttccttttttacttctttacactgccaaagttcagcagagaagctgacgacttagacgtgcagcgtgaacttaaaggtcagggagcacaataaatgaagcaaaaaggactttcttctatagaaagtcctttttgtatggctctgaaacacaacggcgcttatcttttttgttcttcgaaatgattggaaacaaaatgaatgattctttcaactgcataaatgctaataaataggatgagaaatagaagcaaaggatgaatcggctggtcatctatcacgtacacaatgcatccaacgacaaatgcgaccaataaaggagttaaaatagctttcaatcttaacaatcctttctgttctcatagaatttgatcttcttattttataacatatttttctttttatgaaataaaagggagtatatataaaatcgcagtatttttaattaaaaatctttacatctttgggaattttatagtagtatagtcaggttggaggtgagaggtatgctaaaaagttattattttattcatacaaaagatgatcaaggtcagtatgttgtacatacagaagattgtgcatttttaggtgatgctgcaagccgtaaattgattggtctgcacatgagtggcgagagcgccattgatgaagctaaaaaaatgacgaatgaaactgattttaatggttgcttctattgcgcttattcaagtcataagaaatagaccttatgatgaaaccatatgttcgacatgttgtctggcatatggtaaagtctcaaatgcaaaatgaatacaattgagaaactacccatttatttaaaataggtagttatcatgaactaatagttcactacatatatatttgattcagtcaattattctgcgcttcttgcaatgaacgtctcttcttctttgtccattaacaccaatggcaccatcacaagttatgtgatgaatatacgacacctttagcatatataaatttaaatacgccgcattctttccacctgaagcagatagaagaaaaatcaaattggatagatgctagtgtctttgctgacctttctgccatttttatcttcacccacgttttagaaccttcctgaatggctattgtacataagagggataggaatcctatcgctttttacaataagtctatttgcaatttactaataaaaacgtataatttatactaagcacagaaagacgaaagacaaaggagagaaaaaatggacgattatgctcatactaaagacatagaacctacagcagaaaacatcgcaaaagccatttatactgttaaccgccatgctaaaaccgcaccaaatcccaagtttctttatcttttgaaaaaacgtgcgctgcaaaaactattgcaagaaggtaaaggaagaaaagtgggcctacatttctctaacaatcccaaatatagtcaacaacagtccgacgtgctgattgaaattggagattattattttcacctgccaccaaccaaagaagacttcgaatttttgccacacttaggaaatttaaatcaatcatatcgcaatccgaaagcgaatatgtcattaaaccgagcaaagcagctgcttcaaacgtatgtcggtttaaaagaaaaacctaccgccacaaaacaaaaatcacattatacaaagcccgtcttcaaacgactcggggaaagttatttttaaacaaaaaaccactcatgacgagtggtttttcctttagataataaagtgatcgactttttcaatcagctgatgaatttctggtttactaatttgatcatctgcaccgattgtttcccctttatggcgcaaatcttcagtaattaacgaagagaagatgagaatcggtatggaactcgttaaaggattttccttcaacagtttcgttaatcggtgaccatccattttaggcatttcaatatccgtaataatcatatcaatttcttctgtcacagtaattcctttgctgacaaggtccatgacatggtcatatgcctgtttcccgtcttcaaaggtcacaatgtttttatagcctgcttcggttaattcatttgttaataaacgcatgagaagcggagagtcttcaacgacataaagcttcttccctgttcttctctcgtctttctcaccgtcaaacatatgatacgtttctacgccagaagcggattcaatatcataaatgattttctcgtaatctggaaggaaaatcattttctcatcaagcttaatgataccggttaaatgacggtccatcccttgattgagtgcagttggcttttcaatctcttcccagctgacgcggtgaatttgtgataccgttcctgtatggaacacaaatttccgttggttgaattcagtcacaatatatttctcttgttctgactgatctgactcgacattaaaaaaggaaaatagattgatgactggtaaaatctcgcctcgtaaactaatcatcccttctacatcttggtgagagtgcggtactaccgtcacctcaaccggctgaatgatttctcttactttcatgacgttaatgccgaattgatttgaaccaatttcaaacttcacaatttccaattcattggtaccagagtcaagtaaaatttcttgtttgtttaaagccacggaaatccctctattcttcaatataagattgtactttttatatcggcagcataggtaaaaagttgacgtttctttacgctttctctcgtacgaattgatgaatcacgagtcctatcgctgcaagaatgagtaaagaccctagtgcaaggcggcttgcgagatttccgtgctcagcaaacagcagagtgactgacccataaatgatgggtccaataatggacgacaccttccctgagaatgcgaagagaccaaaaaactgtcctctcttttccttcggtgtcagctcgataatcaatattcgtgatgctccccagcttgcaccgagtgaaattccaaataaactgccagccacccagaagacccattctgttgcggctgtcacagccaaaatcagagcaacgatcaaaatcacatacacgactgtaattgagcgctttgccccaatcgcttttgtgatatatccaaataaaaaggagccaatgatacttgaaatagtcgacacaagataaaggagtataaattgcccagcggtaaagccaatgatgattttggcatacacagccatcatcgcaatcgctgtctgcagggcatcattcataaaaaagaaagcgatcataaagataaaagccggcttgtaatgcttcatctctttaaacgtgcgaataatttctttatacccgctgaaaaatgacgcctttttctcttgttgcggcagtggatgagggtcttttacaaaaaagagaaatggcaggaaaaagagaaagaataaaagtgctgtcggaataaatgcttcatgaaattggtcattgccaacaagtaaataaactgagagaccgacgagtgtccctaaataaccaacggcaatgccaaatccagaaataagcggtatttcatcctttgtcccaagatcgggcaggatggtgtcataaaacactaggctcgagtgatagaagaattttgcgatcacaaataaggtgacaacgactaataaagagacaggcagcccaaaccattcgcttgagatatcaattccagcaaagatccccatcaaaaacgtacaaactatacatatgagagtaaacactgtgatgtagcgcttcttttttcctgtacgatcgatcaggactccgtataatggtgtgaaaatgacgagaaaaaaactggctagtgcatttgcataagatataaatgtactagcgatctgatccattcttgcactgtctccgatcgtttcctgcaagtagaacgggaagaaaatggtgatcatattcgatgaaaatatcgtatttgcaaagtcatacaatgcccaggccaaaatgggtgctgtcaaaaacagcccgaagcctgccccttttttctgcatggtctttttccctgttttcaatcgtttgtctcccttccctgcctaattttccactatgattctattttatgtcatacgtccctcttccatacaagcaatctatagaaaaagcacctcttacgattgagcagaggtgctttttttcattatttcttcacaacaatggtacttgcaattaaatcgtgaagtgcttgttttttctctgtgaagaaggcaatgatgtagccaatgtataggattggagacaaaaagccttttgcaaaaaagcggcctgttgcacggccgaatgtcactttttcacccgttactcttgttactttaatcccaagagccattttaccaagcgttccttgtagttttgatgattccatgatggcgtaatatagccatgtcaccacgataccaaccaagatcgctcctatgtagaaaaagataagtcccataatcactgcccagtcctcatctgtcataacagttgttgaatagtaatagctgtcgtcatccatcatcattgctgcctcaggacttgagacaaaaaagagtgttgccaaaataaacatgacaaaagaatatggtacgccgatgataataccatctaaaagatgtgcaagaaaacgatagcctacgcctgctagttcaggatgcttcttttctagaatgtgtggttctgttatgtttgtttccatcctatttctcctttattatgtatgttttctataaatttcttataatcattcgttattatatcttatgaatatcgcaagatcaatgtaactttacacttttacatatattttagatcaggtcgtcctcaatgatttatgcgaataaatactgaaaatttgtgaaaatcatggcacttctagttcttttacctcctaattttttaacattttgtgatattttcgtcttgtttccattctgctgttgacaatcattcttcacatggtacaatagtcaaggattttttaaagaaaggtgttcatgatgggaactgtcgtactattaaagaacaatgaaatgactgtgattgaagatatttgcgaggccgattttttagacatgaagcatgatttgtcaaatgatgacgcagcttatatctcttggtatgaagattacgatactgcttatggatattgatttcatttcatagatgaagcgtaaaaaaaggcgatacaacctaagttggttgatcgccttttttacatttgcgtgcttctttcactttcaggttctacatgaataaagatttgtgcatgcggaaattcttgctgaatcttctcttcaattcgatcacataattgatgaacatcttcaatcgttgtcttgccatttacaatcaaatggaaatcaatatattcctctgcaccggatcgtcttgttcgaaagtcatgatattcgatgaactcctgactgaacccttgaatgattgcttcgatcgattgttcttcctcgggcgttagccgggcatctacaagcggcgggaaagcctctttcatgagtttaaatgcttcgcgcataataaaaagagcaagtatcattccaatgatcggatctaggaaataccagtcagttaatgcgacaagcaataaactgactgccacccctaatgacgtatacacatctgttaacagatgcaatgcattcgatttcatggcgacagaatggaccctttccgcctctttgttcacaaccttcgatacgataaaattgatgatcgcgcctattagcatgaccacaatgccaagtacaggcagcttgactggctctggatgcattaatttgtgaacacattcgtagatgatccaaatgcctgcaacaaaaatcaacagagtttcaatcgttccagaaatattttcgacttttccatgtccataaggatgtttcgaatctgctggctttcttgaaatacgaacagagataaatgcaataaatgatgccattaaatcgagaaaagaatgaatagcttctgataacaccgcaacagatccagtgagcagacctacaatgatttttaagatgacaacaaatgtgttgctcatcacggatagaaacgctattttcgatgtcttcgctgattgttccatttatcgtcctcctttaggagatcgtatgtctatgaaagcacttcccatgacttgattctctcgttctttcagtttacacagttttgctgctttctaatcatgttcatcgcagcctgtattttctcgtgaggttacgctataataaatgttgctctttcttcaatatatcactcatgctgtgatgaataggagaatagactacagataatgatatccagtgcctttcgcaggtgacatttatgcagtgaatggtaaaataggataaaaacataaatttttaaggtgatgagaaatggagcatttgctgaatccaagagtaaaggatattgaaatttcaggcattcgaacattttcaaatctcgtatcgtcatatgaggatgtcgtttctttgacgataggccagcccgatttttatacgccgcatcatgtcaagacagctgccaaagcagccattgatgagaatttcacctcgtacacacataatgctggttttctagagctaagacaagcgatccagcattatatcaagaagaaagtcaatcttgattatgaagctgagtcagagatcattgtgacgacaggtgcaagtcaagcgattgatgctgcgtttcgaaccattttgtcagagggtgacgaagtgattttacctggacctgtctaccctggctatgaaccgatcattcgaatgtgtggcggaaagcccgtacatatcgacacaacgaatgctggctttaaattaaatgccaagctgattgaggatgcattaacggaaaagacaaagtgtgttgtgcttccgtatccttcaaacccaactggtgtcacgctttcagaagaagaattgaaagagattgcccagctccttgaaggaaaagacatctttattttatccgatgaaatctatagcgagctgacatttgaccggccgcatcattcaatcgcttctttcttaaaggaacagaccattgtgattaacggactgtctaagtctcatagcatgactggttggagaattggctttttatttgcttcagctccaattgctaaacatgtattaaaagtacatcaatataacgtgtcttgtgcctcggctgtctcacaaaaggcggcacttgaagctgtaacaaatggtgtggatgatgcactcatcatgagagagcaatataagaaaaggctcgattatgtatacgatcggctcatttctatggggcttccggtcattaagccttctggcgctttttatatttttccatccattgaatcgtttgggatgagttcctttgatttttgtatggagctgttagaaagcacaagacttgctgtcgtaccagggtctgctttctctccactcggcgaggggtatgtgcgtctgtcctatgcttattcacttgaaacactgaaagaaggacttgaccgcctagaacaattcgttcttgaaaaacgttccattcatttaacagactgaaacaacggctctcctgccgttgtttttattttgcaggaaacatgatgtgaaatacggtgcccttttcgggatgactatctacacggatcgtcccgttgtgattttctaaaatattaaatgtgaccataaggccaagtccagtccctttttcctttgtcgttaaaaagggctctcctattcgcttcatgaccgattcaggaataccgaccccttcatcacgaatggtgacatggattccatctctttctgctttggccgtaatgtcaaccttccctccatccggcatggattctacggcatttttgattaaattgataaacacctgcttgagctgattttgatccccgttcatcaggaggccctcttctatctcacttgtgttcattaaaatgccatttaagttcgcttgtgtttctaataaagccgtgacttcgctgatgatttttttcaaatctagtgtctgcatcgatgccgtttgctgcggttttgccagcatgagcagctcgcttaaaataatttctatccggctcagctcagagaaaacaatctcgaaatattgatcccgatcttttgttttcggtttaatgagctgcaaaaagcctttgatggcagtcaatgggttcctgatttcatgtgcaatgccagcagctaattgacctgcgatcgataatttttcagatcggagcatgagctcttctgtctgcttacgttcggatatatctcttaaaataatttgaacggctgtttctccaaaaaatgtagttgggatacacaccatttctgtatagatcagcttgtgcttaaatgtatgacagctcatcgtgacaatttcagaatctgatgctctttcaataatacgtgatatgctctttttcacttttggctggtcacaggaatggatttgatgggaaatatcttttcctattaatttatcgtaatgctcggcttcaaataatttaatgcctgattcattcataaacacccatttgtgatcgtgaatgaccgcaatcgtatcaatggagttttggatgagcagctgatacctctcccggcttttttgcagaacggtttggaatttcttacgggatgagatgtctactaacagcaaaagctctgcccgctgattttgatagatcgttggtgatgacttcacttcgatatgaatgctgctcccatctttccgcttccatatctgttcaatcattccgactggaagaccttgctgcagcctcgtaattcggcttctcacaatgtcatggtactcctcagcaataaagtcaaatgcagttttgccgatcatatcatctcttgtacttacccccattaattgaagcatcgcatcattcgcataaacaatttcccctaaaatcgtaatacataacggatttggcagcatggcaatcaattgttcagcttcactgacatgttggaaagccggcagactgcctaacgactgttctgacacttctgatgttgtttgaaatgctgctttttgcggttcagcgtccagcaccctcattttcaggatcatttctctacttaattcactgtctaactcatcacaatcaacaaaatcaatactagcttcaatccatacagctgttaggtcacttctcagcagcctaaagtggcaaatctccagcatgtgctgattgtagaaataactctcgacgagaaattgatcttcggtatgaacaaagtctttcaaaaaacaccctagtaaatccttttgttcatagagcaaaagctgcttacagttagaagaaatgtagagaaagcggccattagaagaaagaacggcatgtaaatcgatattcgaataaagctgattcgaatctttcattttttgttccatcgtcgtccgaccctccttttcattttttagggttgtccttagattgatgtataaaaaagattcgctagaaaacccgtattttccttccgtcatcgagggaaacgtccatattttcagcaaaaaagagcacattctcttgctgtgctctctgctgtttactgcttttcgtatttcttttgtaattcaacgtacttatcaacaattttacttggaatggttttaatgacaggatctttatctgagacgtaaggcgtcacgacactaaaagccacttttggattggacgatggatagtatcctccaaaggttaaattgtatgttggattgccccaccagctgcggttggcaccatagtaaaaggtttgggcagtccctgtttttcctgagacatcatgctgaccaaagcggcctgcggcagtaccgccggtcgatgtgaccattttcagtcccattttgacacggtcaatatctgctttcgagttgttaatcgtgttcaataccttcggctcatattttttcacgactggacctacctcatccttcttcgttggaagatgaacgcttttcaccactctcggctgaacgcgatttccaccattagcgatcgttgacatatactgggcaacttgaagcggtgtatacgtgtcatactggccaattgcttcatcgagcaaaagtccgccgaccgtcttcggatgtgtctgcatcccgcttgattcctgcggcaaatcgatccctgttttcacgccaagaccgaattgcgcatagtagtttctcattttttgcaggtgttcaggtcttgctggtaacggaccatccttttgataagtgatgcctgccattctcatcgctacttggaacatgtagacgttggaacttttttggagagcctgaaggtcattgacccatccaagaactttatatgactgtttcggctttccaccacttcctgcaaaaaagagcggtgtatccatataggattggttgtgcgacattccgtcctgataaccgccaagtactgtggctcctttgactacagagcccatttcgtactgggtcgtaaatgttccgatggcataatcagtgacgtctctgccgtccattttcttgccagacatcgcaagaacatccccagtgttcgggtccatcatcacgacaaatgcgcggtccatcatatagtttctcgcactagcggatctaagctctgattcgacgatcttgtcgacttccttttgcagctccatatcaaatgtcagtgcaaggtcaagtcctcttcgtccctctgtccgcttgatttcatcgagcagcttcccgccaacctgagtatattgaacggtcgctttctccgggttcagaaaatcctcgtattgatactctaaatagctcttccctactcggtcattacgtgagtagcctcttgccatatagtattcttcacgctcttttataatcccctgctctggtgtagtcacaccgccaagtacattataaagggtcttctcatacggatattttcttgtccaatcattgatgacattcacgccaggcagttcatcaagatgttctgacacaagtgaaatctcttcataggtcaaactcacagatgatgtctgctttgactcttttgtttcatcgagtaaagcaactttttcgtccccttttttctcttcatttgggtccattgctttcacgatttgaggctcaaaggcatatccgcctgtaaatctacgatagatcgctgcaactgctttttcctctgcatttttttcgatcgccttgacctcttccttaggcacacgctctacttgaagcggatagacatcttttgctttaagtttcttttgctctgcttttgaaatgagcttatccgcttctttcggatggcttgccagccaaaaatctcgaatgtcacgctctctcaaaaaatcagtatccatttttatataagtcgcaagttttcttgctactttaatcttatccttcgccttcacaccgctttctgatgtataaacgatggcaggtacactttcgttatcaacgacgactcttcctctcgcgtcatacatttttcctcttggggacgggtatgatgctgttttgacctctgttcggtttgcttgctttttataatcctcaccattgacgatctgcagcacaccaagcttgatcacaagtacagcaaataaactaaagacagcgaagaaaaagagattaatcctccaggcgttccggcgcttgaattttttctgctcggcaccaccttgatgctgtttctctcccacttatgtagctcctctcatcctttcaatcttttacaattaccactcattattgtaacacttttgtaatagttgttacagcgaaacaagtgaaaaaaagctgtcaatccctattatgaaaaaaaatatactaacactttaaaatattggtatgtttatgtcgttttcattaaatggaagaatcccctatcctttgatatgaggcggatttttttatgactttaacaaaaatgacaaaaaggccttgtcaatggaggatgctggtacgtttataacaaaaagtccatgttatgattttctgtgagaaaacaaaacaaagattttaggaggagttacaatatgaagaagaaatcattctttttttcagcgctaacggctgctgcactcatcacgttcactgggggacattcagctgatgcgaaggagcttaacctgaaacaagtgatacaagtacagcatcaaactattgatcttcatacattagctgcaaaattacatatctcttcagatgtaaacaagctaagcaagtcgaatcaaaaagagatcgaagctcttttaaacaagctaatcaaaagcggtcaacctgttactggcacaaaagtggtgaaagaagtaaacaaagcaaaaaatgaacaaaaacaagaatcagtgaaaaaacctactgcttctaaaccaagtacgccagcaaaacaaaacacaaacaacaataacaatacaaaagctgaccaaaaagacacaacagcagcaaaagcagacagcagcttgaatgcatttgaaaaagaagtcgttgagcttacaaacaaagagcgtgcaaagcaaggattaaaagcactttctgttgattcaaagctaagcaaatctgctcgcgcaaaatctcaagatatgaaagataaaaactacttctctcatacaagcccgacttacggatctccatttgatcaaatgaagcaattcgggatcacttacaaatcagcaggtgaaaacattgcccaaggtcaaagatctcctcaagaagtggtgactgcttggatgaacagtgaaggtcacagagccaatatcttaaacaaaaactatacacatatcggtgttggttatgtgaaatctggcaactactggacgcagcaattcattggaaaataagatcaaaaaacctgtcccctatatgggacaggcttttttatttcacccataatttatatatactctgtgtgccgctgttttcttctccctgctcactcagcttttcatatagtgactttgcaagtgagagtcctggcatttcttctcccatcagctctgcttcttcaagtgctatgcccatatctttaataaaatgcttcacgtagaaccctggctcgaaatcacctttcagcattcttggtgcaaggtttgacaaggaccagcttcctgccgcgcctgttgttatacttttgagcacgtgctctggatcaagtcctgatttttcggcataggccatagcctctgcgacacctaccatccctgctgcaatcgcaatttggttacacattttggtatgctgaccgctccctgcaggtccttgatattgaatgttttcgcccattttctcaaataaaggaagacacgcttcataggctgatttttctccgccaatcatgatcgcaagcgttccattttttgcacctacatctccaccagaaactggtgcgtctaatgcaaacagccctttttctttcgctttctcttcaatttcttttgccagctgaggcttcgatgtagtcatatcaattagataagtaccaggcgtagcatatgccacaagcccctcttcccctaaatagatttcttctacatctgatggatatcctaccattgtgatgacagcatctgcatgttctgcaatttccttcactgccggcttccatgatgcgcctttttgaatgagtgcatctgcttttgcttttgttcttgtataaacgagaacttcataacctgcatccattaaatgttctgccatactgcgtcccattacaccaattccaataaaaccaactgttttgattgtcatcacttattcctcctcaaagagactttgtcaatccaccatcaatgataagtgtttgacctgtcatgtatgtacttgcttcagataaaagaaaagctgcatatgctgcaaattcctctggctgtccataacggccaagcggaatcgcatgttcagcctgtgctttgatttcttcaaccgtttggtgctctgactgcgcgcggtgcttgtccagctgtttgactcggtctgtttcaatttttcctggggctaacgtattaatcaaaatcccatccttggcaagctcttgagcggctgtttttgtccagcccacaatagccggtctaaaagtatttgacagcatcaagcctgggatcggttcttttactgacatagacgcaatgtttaacacgcgtgcaccgcgttttttcaaataaggcaaggcctcttttaataatcgaatatagctgagtaaatgaagctgaaatgattccatccagtcttcatctgttaaggtttcaagcgtccctgttttaggcccgcctgtattgttcacaagaatgtctagatacttctcatcaccagctgccgcttgaactagcgccttgatttgctgcgcgtcagacacatcacatacttgatacgtcagctttccttttacaagcggagataattctttcaccgtttctttcagcgtgtgctcatgccttcctgaaagcatgacatctgctccctcttttgctagagcaaaggcaatggcttttccaataccttgactgcttgcagcgaccaaggctttttttccagataaattgacattcatgtcaacacctcctctgctttattttatcatacaaaaagaaccttgctcacgccgcaaggttcctttctgcttgattacaccttaaatctgtcaaccgcctgacgtaacgcctggcttgattcgttcagcatttcagtcgaagttttcgttctttctaacgcttgaacttgttcatctgtagacgcatgtacttcctcagctgaagccgcagattcttcagaaattgcagcaatgctttgaatggagtcactcatcttctgctgttcttctgtcatttcattgatctgtgtatgaatgctgtcgattgatccgacaagtgcctgcatttccattgtgatgctgctcagtgcctcgcctgttgcattaatggcgtcaccttgttcttcattcatcttacttgctactgtcatcgcttcagccgccttcttcgattcatcttgaatgagtttaacggtttcactaatgtgttttgttgattccgcagattgttcagcaagttttctgacttcttctgcaacaacagcaaagcctcttccgctttctccagctctcgctgcttcaatgcttgcattcagtgcaagtaaattcgtttgatccgagatttgagaaatggctgtcactacattttcaatattttttgttttatgctccaggtctagcagcatttgctctacctttttcgattcttcgctcgcttttgttgatttttggacgagcaccccaagtgcatctagccctttataacttgcgtcttctgatgattttgagttggtttgcatttgtgaggcaagctcacccatatggcgcactttctcatacaaatgctctgatttctcattaatcgtttctgcatctgaagcctgcttagtcgcccctgttgccacctcttgaatggccgttgcaatctgctcgctcgacagcagggtttcatttgaaatttgggtcacttcatccgttgatgtcacaacttgatctgaagcccctttcactttttcaattaactccctaatgtcctctatcatttgattaaagcttttcgtgaggagaccaatttcatctttggacttcacttcaagcgtacttgttaaatcgccttctgacaccttacgcacatgccctgttagacgcttgattggcgttgtaatgcttcttgccaataataagctgaggatcatcgcaagaataatggcaatgacggatattatgatacttgtctgattcatttgttctgtgatccatagcagtttctttttctcaaagctcacgccaaccgtccaatcggcttctttgattttagatatgaccgtcagttctttgctgtcatcaatacctgagttgtcaagcgcttttttcacagaggagacctttgatatgttttttccttgctgtgttggatgcgccaaaatggtgcctgtgttatcaactaagaaagcggtccctttataagggatctcttgttcatttatataagattgaatggaggagagcttcaaatcaagtccagcgactccaatgacctttccatttttgacaatcgccttcgtggctgaaacaatcacttttttcgttgcttcatcaatatatggatctgtccaaacaacctgatcaggcttttcggctgcttgtttaaaccagccttgtttagatggatcataccctttgccaagatcgaactccgggaagccgagcattttgccatcagttgttccaatataagcaaacgaaatgagtttatcctgttcctgcaggttttttattgcacttttttcaaaatccagtgtttgttttgtttgtttttgcgcaaattcttcagttattttacctgttgccaatttgttaatggtattgccgtaattatcaagcttttctgtaataatgtctttcaggctttctgccgttgctgtggcggtcgtttttgcatctcgttcaatcagtggtgttaataccaagttggaacccacttgaactgccacaacggttaaaattaaaataactgagatgaaaacagctattctcacttgaagtttcttaaacatctcctcacacccctatatcctactttcataccttgttgtatatatcggcattattgataccgcattcaatagttgtgagaaaatttaaatagaaaaaacaagccataaaggcttgctttaagtaaaatattcaatttttgcattcggaaagtactgatcgatatatgattctaacgtctgtcttagttcttgttcctcatctttttgatagatatatttcccaattccatatctaccccacttgtaacgtcttttttcttcatctaattctaattttgatttcggatagtttttttggatcacacgcttcgctggttttgtaaaacgatgctggatcatttcaaaggtgatatcgtgcctcacatcttcaggtagagctgcatcgagcttttcaaaaagaactttatatccttcctgccagccttcgtgaatgtagattggggcaataataaagccaaggggataacctgctttcgcaaccttgacagccgcttcaatccgctgatctaacggtgatgtaccgggttcgaaatatttaatgacataatccgcattgatactaaagcgaaatcttgtccggccattatgctttgcatcaagtaaatgatcgacatgatgaaatttggtcacaaagcgaagcttgccaagatcagtctggccgaagtattcaattgctgtctttagtgtatgtgtcagatggtcaattcctacaatatctgacgtacaagaagcttcaaatctcgtgatttctggcgcacgttcgttcatgtactgctccgcctgatctaatatttcttcaacattcacatatgttcgaatgtatggcttacttcccatcgtcgtttgcagatagcaataatggcaatgccccatacagcctgtcgcaaatgggatcgcatactctgcagatggtttagacgtatcgaacttcaacgttttcctcacaccaatgacaagcgttgatttcgcattacgatacttttgcaagtcattcttacccggaatatttcttacttggttatgtgaagtcgtttcccttatttcaatccccatgccctcgaacttttccttcagttctcgtcctaacgggtactctaacgcccgtggttcaatgtacacaagctggggcacaaaaggtttgatcatatttagcacatccttaccctataggttttcataccgttactttaaccgtgcaggatggcttttatcctttctaaaatctcccttattcaaacaaatcttgataaagagcttctgcttcttcatatgtcgaaaagaccgcatcatctggagctaaaggatggtacgtttcaagtaaaaatagggcaagctcctcttcgttgtatggatgtgaaacaatttctgcttctttgatttgtgctacgtttgctgcatgtggatttcgataaatcacatagacttgatcacccggttgatagtctgagaaaggcaatctggtcacctccatttttcttatagaatgcccttctctctgacggatatgacccaatatgataaaattcgacaaaaaaaccagacaggatgactgtctggtttgaattcacttagttatgttgaaacgttttcttcacgaaatcaaccacttcttctgtagtgctaagtgataaaatatgctctttaaatgatgcagcttcttccttagaaagcttgcttagctgagttcttgctggaagaatagatgttgcactcattgagaattcatctaatcctaatccaagtagaagaggaatggcgatttcatctcctgccatctcaccgcacatgccaacccatttaccttctttatgcgctgcttcaataacaagcgtaatcagacgtaaaatcgctggattgtaaggctggtaaagataagacactcgttcgttcattcgatcagcagccattgtgtattgaatcaagtcattcgttccaatactgaagaaatcaacctcttttgcaaattggtctgcgatgacagctgttgatggaatttctaccattataccgatttcaatggaatcggatacgtctgtaccagcggcaaccaatgcttctttttcttcaagtaaaatggcttttgcttctctaaattctgataacgtcgcgatcatagggaacatgattttcaagtttccatatgtacttgcacgaagtaaggcgcgtagttgtgttctgaaaatctcctgttcttcgaggcaaaggcggatcgctctaaagccaagaaacgggttcatttcttttggaagctgcaagtaaggaagttctttatcgccaccaatatctagtgtgcggacaaccactgctttgccttccattctctctaaaacagttttatatgcatcgaactgctcttcttctgtaggaagctgatctctgcccatgtataaaaattcagtacggtacaatccgactgcttcgccgccattttcaagtacaccttttacatcttcaggtgttccgatatttgcagctagctctacgtgaacgccgtcttttgtgaccgttggctgatcaacaagtttcgcccattccgctttttgagctaagtagtcttcatgctttttttgatacgctttcacttcatcttcagaaggctgaatgatgacgtctccgctaataccatcaacaatgatcagatcattgtttttcaccgtttttgttgcttcttttgttccaacaacagctggaatctccattgatcttgccataattgctgagtgagaagtacgaccgccgatatctgtcgcaaaacctttgacaaattgtctgttcagctgagctgtatcagaaggagtcaaatcttcagcaatgatgatgacttcttcagaaatcatgcttggattcggaatgtcaacgcctagcaaatgtccagttacacgttttgttacgtcgcgaatatccgctgcacgttccttcatgtattcattgtccattgcttcgaacattgtgacaaacattgtcgctgtttcttttaaagcaaattcagcatttactttatcagagttgattttatcctttactgggtttagcagctctggatcacttaacacaagaaggtgtgcagaaaagatatctgctttgtcttggccaagctcttttagcgcatgttctttaattgcttcaagttcttgtttagaaacatgaattgcttcttcaaaacgcttcacttctgtctctggatcgttgatgtctttttggtgaactgttaaatctggttcttccagacgatatgcttttgcaatcgcaacgcctgctgaagcaccgattcctttcagttgttgcattactcgcctaggccttcacttttcattgtgtctttaagtgcagcaagtgcatcattttcatcagaaccagaagcagagatagtgattgtagcacctttcgcaattcctagagacattacacccataatagatttcaggttcactgttttaccattatattctaagttgatatcagcatcatatttactagcagtttgtacaagaactgttgcaggacgtgcgtgaattccagaatctgcagttactttgaatgtttgttgagccatttttatcaatctcctttttatacaattaatacatccacaatattatatcatactgccgagcttgtcatctaacaagaacggcagttatgaaaattattttgaaattttcatgatgttttcttgaccagcgttgatttcaccggatttttgaaggtcaataaattgtccttcacttaagttggtaaatacaattggtgtcattaaagatggtacttcagacttaattttatcaatatcaacctctaagagtttttgaccgatttctacttgatctccctcttgtacaaatgcttcaaatccttctcctttgaggctgaccgtatcaataccgaagtggattaaaatttcaagtccaccatcagattgcaggccaattgcgtgtttcgttgggaatacatttaagatcttccctttcaccggtgaaaccaccgttccatctgttggcaagatggcgaaaccgtcacccatcattttccctgagaatacttgatctggtacatctgtaatcggatgaagctcccctgtaattggtgaagcaaagatttcttcaccttgctcgttttgaagcggttttgcaatgacttcttcgacctgctggctgacttcttcttttgcagaagggtctttcgctggacgaggcgtgcggcctgcaatgatgtcctgcatttgtgtttttaaattatcagagcgtggtccgaagatagcctgaatgttgtttcctacttcaagaactcctgaagcaccaagctttttcaagcggtctttgtccactttcttctgatcattcacagtaacacgtaaacgcgtaatacaagcatcaaggtgtttaatgttttcttggtcacccattgcttcaagaatttcataaggcaagtcattacccttttcagacttagcactacttgcaccgtcagctgcttcatcctcacggcctggcgttttcagattaaatttgcgaatagcgaatctaaatccgaagtaataaataacggcaagtacaagaccaactggaatcacaagccaccaagcagttctgtttggcaagattccgaataagaagaagtcgattaatcctcctgagaaggtcataccgattttcacgtttagaatatccattatcataaaggataatccagcaaatacacagtggattgcaaataacactggtgcaacaaataagaatgagaattcaagcggttcagtaatccctgttaggaaagaagtcagggctgctgatcccataattccagcgacaagctttttattctttggttttgcttcatggtaaatcgcaagtgctgctgctgggagtccaaacatcatgaacggatatttccctgtcatgaatgtaccagctgtcagttgaacaccatctttgatttgtgccatgaagatacgctgatcaccacggacaagctcacctgataagctcttataactaaagaactcataccagaatggcgagtagaaaatgtggtgcagaccaaacggaattaatgagcgttcaatgacaccgaatacaaaggcagcaagcggctcattcgctgcgagcagtcccgttgagaacgagttcagtgcaccttggattggcggccaaatgactagcatcaaaagccctaaaataagtgctgaaatagatgtaacaattggaacaaagcgttttccagcaaagaagccgagatattgcggaagctcaattttataaaatttattatacatataagctgctaataccccgacaataatcccgccaaagacgccggtagacaaggtcggaatgccaagcatattaatatacgctggatggctttctttaaagaacttagccaatttgatggaatcagatggaattgatccattggccattaatacggcactcattgtcacgttcatgacaagataaccgataattgcggcaatccctgccacaccgtctccattagctagaccgatggcaacccctacagcaaataagagcggaagattcgagaagacaatgttccctgcattttccatgacgcttgcaacaagctgaattgtatcattgcttaaaaattgagctacatcaatcagctgcggattttgcatcgcattcccaagtgctagtaaaataccagcagcagggaggatcgcaactggaagcataagtgctcgtccaattttttgcaacacaccaaaaagtgatttaaacactagttgaacctccttttattttcgcttacaacgcacatgcgggacgctccctgacatccatttcatagttaaccgtttacatttcactttcaaacacaaaaaaaggcatggtgatataaggttgcgcaaataacaggatcttatcctgtatttaccttaagtcactcatgcctgatcgaatcagttacacgtttctaggaaactatgaaattttatttgtcaatctgtacagatgaagtgtcaggtagacagcctctgcatcctgtacaggctttttcaatgcatgttgtaatattttgatcattttccaagcagtattgtagcataaaggatattcatttttcaatagatgaagcaatttttctggctcctctaaagattcttcccgtttaatacgctcaatcgaaaacgtaatatggcgcaataagcgtaaataatgaatactttctctgtcgactttcatatgaaatgaatcttctatgacttggaccatttgcgtgatgagctgcgaatgacggttcacctcagataatggccgattcgttaaagctgagtgaatatggagcgcaataaaaccaatctctccttctggcaactttgtttcgacatcaggacgctcgttaatgagctcaacgacttcctttgcgacctcgtattctttcggatacagcgattttgtctcaagcataaagggattggtgatatcatatccttgctgcacccgcttaaaactaaacgcaatatggtcagtcagggcaatatgaatatgctcattcaaacggtgtcccattttttctcgtatatgataaatgacgtcattggcaagctcgatcatgttctcatcaatttggtgaagcaactgtttatattctgtttgttcctttgtatttttaagaacaaacattttttcaaatgtatcttgatcgagaacatcacccgattttttcccgaagccaattcctttcccaatcagaactacttcgcccaaagaagggtgtcttgcgatgatgacattattatttaacgctttatcaacggtgaaggattccatgaacatccccacctccttcttattcaatccctcttatcgtacaaaacagatgaaacgtgcgtcaacgattgtttatgaaaacggtggttgatcgctcgatcaggcgaaatggcagcattcttttctctggcacctctccttttatagctcggtcgaacaagtcaaacgcttcctgccccattcgtttcagcggaatatcaatgctggaaatccccaaggcctcacttaattgatcattttgaaagccgagtatggctggagattctcctacttttatatcgtgacgctgcgcctctaataaaaagcctgctgatacgtcatcatttgtgatgaataatgctgtggggcgattcttcatttcttgccactctgtaaataattgttttccatcaaaaagtgttagcttcccttcgatgacccattcttcatcaatctcctgcccgagcgctttcatcatatcttgataagcttgaaggcgtgactggctgtttgcgccttctattctggctagaacaattgcgattcgctgatgcccgcatgctgctaaatgatgcagcccttctttaaacgcttgatcatgagcaatcgacaccgttgaacagtcttcaattggcgccggatggcaaaaaatgataggcccggattcctgccaacttaaaatgtctcgatcacttaacgcatttgagcaaaagattaatccatccacgcggcgctcttttaaactcatcaaggcttctttttcttttaaagggtcatatcctgtttgaaataaagcaaaatgcatgccgcgcgcctgtgctttttctgcaatccctgtgacaagtctgctgaaataagaatgatcaattgttggaagaacgatgccaagcatatttgaataacccttggctaaatggacagcctgaatgtttctcgtatatttgagctctttcatcgcaccaagaactcgttctcgtttatcttctttgacataaggatgatgattcaacacacgtgatacagttgtcacagatacgcccgctctttttgcaatctcccttatgtttgccaatttttctcctactttctcttgatatggtaagcgtttcatactttaagatgtatgtgagctgaacaaatcactgggtggaaaggggaattcaagatgggtttcatcatatggattatattatgtatgactgttttgttttctgctcgttttgcactacatcctttaggaaaagaacataaaatcaaaccgtttcaatcaattgatgatttttttgttgataaggatcgaaaagagtgacaaaaaatcacgatgacacttccaggacatgggcgttcatcgtgatttttttattacttgatgatcgtcagctctttcggataattggttaaagtaactggaccatccgctgtgatcagtacatcatcttcaattctgacgccgccaactcctggaacatagattcccggttcgatcgtatacaccatgccctcttggagaagatcatcatttgcctggctcatcgaaggaaactcatgaacagacacccctagaccatgtccaaggcggtgagggaaatactctccatatccagcatctgcgattagcccgcgtgcttttaagtccaggtccccaattctcacgcccggtttactcatttcaagtgccgccatttctgcgtttaggacggtttgatagatgtccttttgctgatcagaagcttcctgataaataaatgttcttgtaatgtctgagcaatatccatcaacaatgacaccaaggtcaaataacacaaagtcgcctttttttaagactgcctgtcctggatttccgtgaggctctcctgatttttcgccaaagagaaccatcgtcgaaaaggacatgccttgaatgccttttttctttagctcatattcaatgacagcgagcacttctgtttcggtgactccttcttctaaggcgttcaccccaatttttaccccttcatctgccaattgagcggcttttttcagtgtagcaatttcagattcatctttaatgagtcttagctgattgagctcttcttctgcccgtacaaaagtttctgccccagtagcagcttgaagctgttctgctctttgaagcggaattgactctttttcaattgcaagccgagttgctcttacaccgcgtttttctactgctgactgaatgaaatcaaatggattctcatggtcttcataaccaataatatcgcctgaccacccagcatttttcgcctgctcgacttccattttaggcaaaataaaaaatggatctgcctcttgaaacacaaacagccccattactctttcatgcggctctgtgaagtatccagatagataaaacacattttcctttgtatgtataaatgcaccttgaatgtctttttcctttagccaagaagacaagcttttcattcggttcatcgtgatcctcctcacacgttttactactgatctattgtatcagtttttgttatatttcgcacaaaaacgcactggcagaagccaagtgcgctatgatgatttgcttaagatgcacgaagcagacgcagtccatttaaaatgaccaaaatcgtacttccttcatgcccgattacgccaaaaggcaaatcaagcacttgtaagaaattcgcacaaattaacaagcaaatcaccgttaatgagaaaataatattttgcttaatgattcgattcatctttcttgaaagacggatcatctttgttaagttatttaaattgtttttcattaagatcaaatctgctgtttctaaggctacgtctgttcctccgcccatcgcaacccccacatctgctgtggcgagtgcaggtgcatcattgattccgtcacctaccatgatgattgagtttccttgtttttttagttgattgacctcatggaccttttcatctggcagacactcagcgacaaccgtttggatgccagcttcctgtgcaatggcttcagccgttttttgctgatctcctgtcagcatgaccgtttggatgcctaaatcattcagctcttgaatcattttcttcgcttcaggtctcatttgatctttaaggccaaggcacccaacgactacttgatccttttgaacatacaccactgtatatcctttttcagaaagatactctcctgtctcttcaatctcacggtccattgaagccttgccagcaaagtctttcttcccaatccgccacgtttctccattcaattgtgcctttacaccaaaaccagaggtttcttcaatggtgacatgagctgatctttctatttgttgctcttgtgccatatcagagatcgctttcgctaatggatggtttgattgactttcaatttgataaagcgcctgataaaaggccgcttcctcttgtcctttagcgatcaccacctgctctacagctggctttccgcttgtaattgtccccgttttgtcaaaagcaatcatactgctagtgcctagcttttctaaaaagacgctccctttgacaagcattccgtttcttgcgccgtttgagatcagtgacaaagcagctggcataatggatgcaacaagcgcacaaggtgatgctacaaccataaacaccatagcccggtagaaggtttcactcatactccagcctagtacaaaatgaggcagaaccattaaaatcgcgacggtgatcagtacaccttttacataagcaccttcgaatttttcaataaatgcctggcttggcgacacactttcttgagccgattcgacaagtttaataattttatggaaaagcgtttcttcattatgtttggtcacttctactgttaaggaaccatttaagttcactgtgcctgcaaacacgtcttcaccttgccctttttcctgaggcacagactcgcccgtgagcgcagattcatctacacttgttcttccgcttaaaatcacaccatctgctgcaatacgttccccagctttgatcatgatacggtcacctggtgttaatgatgaagcagcgacttgaatggtcgtgccatcttcttcaattaaagtcgcttcatttggcgcgatgctcattaaagctgttaaatccttcttgcttttatttgatgtatacgtttcaagcgcaccactaagcgagaaaataaaaattaagatcgcgccctctgcccaatatccaatgatcgctgagccaatggctgcgaaaatcattaaaagttcaacattcaagcttttagacgaaatggtttcttcaattccttccttcgcctttgcaaaacctccaatgacaaatgctaggatgaaaagaggaatgctccacatgctctgatcctttaaaatccatccaattaaaatgagaatccccgagatacctgctgctattaattctccgtgctgtgcccattgatgaagggaccatttcgattccttttgatttgttgtttgataaagtgctgtattctcattcatgattgttttctcctctctaattgataatggttttcacatcatcaattgttgcccgtttccttttttcatctatattttctgctatttcaagctttttataggtctgttattcattataacaggttctgactgattttcaattaataattattataatttctttttgataataattatcattattgatagggaccattccatgttctgagcacagtttattcagatgaaaagaaattgaacacaaaaaagaaccaaaggaatgacccttggttcttgaaataaggttttgttctaaaaattcgtccactctttgatttgttttttcgtcagtggacctacatgatttttcactatttctcctttttcatttatcaaaaagctggttggaatggtgatgatttggtatttcttcatcatgtgccctccctcatctagtatgactgggaatgtaaactttctgtctttcacaaattgggcaaccgcatgtttactttgttcagcacctagtaagttcaccgttaagatatcaacatcactctgattttctttcacgatctggtcaaatacaggcagctccattttgcaggacgggcaccatgttgtccaaaaatgcaaaatggtcttttttcctttcatcggaatcatctgcgtctcaccagttaatgtaggagcctctatctttggcgccataacgggctctttcgctccagcctcgctgcctatgagtaatagaagcatggtcatcataagaagactggcgggtagatatttaagattcatcaggatcttccttcccagttttcttatagcttgcccgctcgccgaagagggcattcatgcttttttcattctaagaaacatggaaacaccgagctccttacaaatcgtcgcataatgcagtgcagtcaagaggagcatgcccgtattcatccctaatataacccccatcatatttaagctttcaattgatccgagaaaatacaccattgaaaacgagacgacatgcacccatatattatgtaggaacacatctttaatgagccccataccgattaagcacgcttgaaacggcatcacaaacaggtggcataaaaagtacggccaaagcagctgtaagtagacagcagcttgcggtgaatcaaaaaagagctgtgtgagcggataagcaaaataatacatcaccatcactgccggtaccccgtacccaaatgtaatgagaatcgcctgcctgacacgttttttcacaagatcatactgacctaaagcataggcttcagatacattgggaatcatcacaatcatgatggaatgagcgataaacgctgggaaaaaaccaatcgacatcgcgacaccagccagcatgccgtaatgatcaacagcaagtgtgccagagatgcctgcagcaataagtgcccctttgattaaaaatggttctatggcatttgcgattgcatgaaaaatccgcatgcccgttgttggaatagagacggctaatagtcgctttctcacgtcaatccctcttaattcaacagacctgacatggacagcattttttgccatgacgtattgggagtataaataaataaagacgacaagatcactcgcaacaatgacaccgatggcaatgagtaccgctgtttcaatatcaaacgaataccaatgaaagaacaaaaacaagcaaataagctggatcgttttcttcagcatattggcaagagcgatcctgcccatttgctgctttcccataaaatagccgcgtgcaatcgaggtaaacgcaataattggaataagagacagcacaagccctttcatgagcggatgatacgactgaaacactggaatgaacggcagaacaatcgcagcgatccccgttgttgtactcgtcaccacaagcgtcattttaaacgcatggcggagcatacttttatggagccgctcatgcgattctgcaatgaatttagaaatggagactggcagctctaagctggcaattacaaggacaagcatgatgattggaaggatactcatatatagacccattccatgctccccaagctctctcgctaaaatcatattgactaaaaactctatacactccgcaatgaaagctgcgacagatagcagaatgaccccttttacaaatcgattcatgtagcctcccctttatctaaagcaaattcttttcacattctatgagacaagtcctgaaaatattttgataaatgaagacaaaaaaaagagcgatctgattgatcgctttagaacattgacaaagggctaaaaatgtttttattttagttctttgtcttcctttcagcgtgatagaaaaccattgcagtctaggaagggcgagcacaggagcgaattgattattcgtgagcaccggagcacagtcctgacaaagaatgcgagggtttgtctacacgctggagcgatctgattgatcgcttcaattctttatacggcaaatacgtgacgaccgatacgttctacaattttgcgagaacgaatccagttatctgttgccgttttgggattataaaaataaatggcctttgttgttctgtcatgttctttcgctacttgcttcacagctttaacagaatcttgatctgctttatcatgaatacttccatttgatactggctggaaagcatttcgctgataaataacacctttgacactgttaggaaaagagcgatgttccaccctgtttaagacgacgcttgccacagcttttttacctgcgtaagattctccttttgcttcagcatgcaccaatcgtgagagcagttccatttcttcattagaatagtgtttggcgctttcctcattcgttgtttctgattttactcttttcttttgcttcggttttgaagacttctcttctgtagacgtacttagcattttgactttcggctgacgcttttcctctgaaaatgctgggatgacttgatcgtgatcatctcgatctatatatgaaagctcatgcttaacaggtgcttgtgaaagttcgtgacttaatgtcccttgctgctcttgtatgttgtccatcttcatggctgcaatcagcataaggatgacaaaaagagcggtatgaattttcatcattcgcctcattcctcctttaattaaagtaggcggtaagatacttgtccactctaacaagacctccttctattttcacgcacaaagatttgcatgcctgtccaaattccgtcattaattggcatgtcctagttgatttgcgtatcaactggaattgttagcgcttaaaagggtcccttttccgcctataaacatccttatgatcctaattatgggttattacattttcttttcagatgtatcaagctcgtttgaagtgtgacaaaagaactaaaataaaaaagctttctctcattcatgagaaaaagctttagcttcttgcttctgtaagatattcaaaaataacatctccaccatgtttcgcaatcccgcgaaaatgcttaaaatcatcttgatttaccaagatcgaacgaaacgttaagaaatcatctttcttgatagttacttgcttttctgtcccatttcgtaacgattcaagtattgtgaggatttgttcttccgtcaaaaaaaccgctcctttacagccattatcaaatattaaatataccatccgttaggaaagcatacaacgaaaacaaaacaaaaacgtctttatcctttacattggtatgaaaatattgcaaaatactttttaatagggaatgaaatctgtttttaaaggagagggatcggttgaagattgcaaaaattggaaatgtgatcgaatttagaaatggtttaacaggtgtagttgaaaaagtgaatgaaaactctgtcattgtggatgtcaccattatggacaactatagagatttagaactggattcactaacagtcgttaatcataaaaactataaaatcatcaaagactccgtacattaatttgcaatcctcaattcagattatcgatacatacgtaaatacgaagcaaagctgctttctgacagtttagctctctttgacaatcacatatgaaaaagactgacaccatatgaagaagtgtcagtctttttgcgtatgaaaggtttgcatttctgctttcgttttgtacatgtccacttcctcgggggtgataacgcctttatcaatcaaaagtgcaatcactccaagcaatgtagaggcactccatttatatcgttctttgttttgatgttcaagcatttgaagttcttcttttagctcccttagcagcttctctgtcttttcttctttgtttaccaactcaaacgcctccattagtcgttcattgcctctattttatcttaaagcaaataagataagcaaaaaacacaattcccctttacaaacatacgttctgtcatgtataattattttacgagctggtagcccccagccgtcctagcaagttctattcccatttgtatgaggagagcgacatgactcttctctttttttatcacttcagtctgaatcatccctttcaaacccatgaaaaaagacatgtcattaggcatgtcttttcctttattagcgattatcaatcgtttctggatacatatcatggttcatcatacgatacgatgccatttcttcatatttggtaccaggttttccgtagttcgtgtacgggtcaattgaaataccgcctcttggtgtaaatttgccccatacttcaatgtatcttgggtccatcaattcaatgagatcattcataataatgttcatacaatcctcatggaaatcaccatggttacggaagctgaacaaatacaattttaatgatttactttcgaccatgatgtcatttgggatatagctgatataaactgtcgcaaaatccggctgacctgtttgcggacaaagtgacgtgaattctgggcagttgaatttcacaaaataatctctatttgtatgtttattcggaaatgtttcaagcacttgtggtgcataatcaaacaaataattggtgccttgatttcctagtaaagtgacaccttctaattcttctggttttcttgtcgtcatgtcttctcttcctttctatacgcctcgtttatttccccacaataatgtgtgcagctgcggcagcactcttacacgatttaagtctgggtcttgcgctacttgatcaacaagcgcttcatatttctttaataaatgcgtcaataagtacgcatcatcacctgttgtcgtgtcatcatttcctacttgcaaataaaaaggaagctctggatatttcccatgaacatcttttgcataggctaaatcatgatcgtcaaaaatgacgaccttcaggcttgcatgctctaatctatttccgtttttcagctcatctatgatacgtgtgagtttcgcgaaatctgttttcatatttgaacttggcggtttcggagaaatcgttaaatcatcaattttcaaaaaccagtcctgatacattgtcccttgtgtttcaagcgctgtatcaattccttcttcgtgaagcaaatcaatgagtgactccatttgttttaaaagcgcagggtttccccctgaaatggtgacatgagaaaaagcctgtccacctattctttttaattctttgacaatgtcttctgcgtgaagccactgaatgtcatgctttgctgagccatcccaagtaaaggcggaatcacaccagctgcaagagtagtcacagccagccgttctgacaaacatggttttttgtccaatgaccatcccttctccttgaatggtcggaccaaagatctctaatacaggtatcgccttagccattgtgctcaactcgtttcggccggtaaatgcagtagcttgttggtgtctccctcacaaagacctgaacacataccggtttatttgctaaagtcgataaatatgctgcgactttgtcatggactgtctttgccacaacctctgtagtaggcatcgcgtatggatcggttgatgagaattcctcatgatcattgagcagcgtgtgatcatatttaccatgaataagttttttcagtgtactgaaattgacaaggaaacccgaatcatctaggtcatctccagcaatggttatattgatggtgtacgtatgaccatgtacacggctgcaagcgcctgcatcttctctcgggataaaatgggcagctgatatatgcatatctttgttcaattcaaatgagtatggatgatttgtttgtggatagatctgagaaagcatttattttgcctccttcatttccatatacgtgtcatagccatttttccgaagcttacacgcagggcattccccgcagccattagaaatgatgccattatagcaagtgagcgtttcatttttcacaaaatctaacgcactcagctcgtctgctagcttccatgtttctgctttattaagccacatgagcggtgtatggatgacaaatggtttttccatcgctaaattcactgtgacattacaagacttgacaaactcgtcacggcaatctggatagccgctaaagtctgtttcgcatacacctgtgataatatgtcttgctccgatttgatacgcaagaatagaagcaaaggatagaaacactaagtttcttcctggtacaaatgtggaaggcagctctccttctttttcttcaatatcaatgtcatctcttgttaaggcatttggtgcaagctgattcaaaagagacatatctaatagatggttcttcacacctaacttgtcagcaattcttttagcgacatcaatttcttcttgatgacgctgattataatgaaaggtcacggtttctacctcttcgaattgttgaagtgcccataataaacatgtcgtactgtcttgtcccccgctaaagacaacgactgctttttcatttttcaatttctgttctcctccttttgcagatctataccctcgtacaaaactgcatctgaaaggctcttgaaaacccctgtttttctcaaaagaaaagacacctttacatgtgtatgaggtgtcccagccataaaaaataaaaaatgccacatccaaggatacggcaagtccttagttttttatagagggttttgctagaacctctcccgtttaaacggatttttgttcaattttcacagaagatagtgtaccatatatttttcatgaaggctatcccttctttacttatcaaatgatgcaggcactttctttagaaaaagaaagaggataaaaaagatgctcacatagccaaaaataggataaaccgttgatatcaatgtgccgtaaccaattttactaatcacatagcagcataagagaataagggatatcgtcaagacactgttcattcgtatatacgccctcacttgtctctccagcccatataaattccctatgacggatgtaaagacttctccgaagatcacaaataaataaatgaggtgaatggaatttgctacttgatacacgacctgagccattggaatatcaaacgcctccagcatatctaatgaagaaagagataaaaagcatacaaataaaataattgtcagcatgacgcccccaatcaccgctccctttttgatcaccgcttcagaggtcatttcatttgcgacaggcactaataccgcttgagaaagtgccaaattaaaagcaccatatgagatagctgataaaatccactctccctcacccatttgcagtgcaagaacataactttcactactgctaaaaacgaatgaatcaagaaacacaatcaatgaaaagaaaataagcattggaacgacgagaacattgacaccaaataagccttttgatccttttaaaagcacaataacgctcagaatgatcgttaaaaaaatcccatattccttcgatatgccaagctgctcttcaaatatagcacctgcgccagaaatcatcactgaagtgacgcctagtaaaataaaaaacatgacaacattaatatatcgactggcagctgcgccaaatagaaaccggttcatatcttgataagactctgcttcaattcgtttagaaatgagcatcatttttgctccaagtccagtaaaaatagcgccgctaatcaagattccgaatagtccaatccagccaaaacgaacaaaaaattctacgatttctttccctgtcgcaaacccagctccaaccactgttcctacatatacaaaggcaagctgaaaagcggattcatttgaacgtttcatgtgacccctccgcacccatcactttcgattgtctttttttatcctatgagacaagttccttgaaaagaaggacaaaccatgattaaatgcaaaaaaaggattttacccgcctttgagcaaaacagttgaaagtcaaaataggtcagagtatactatagtcaaagatggtcaaacaacagaccattttctttaacattcattggtcaaataaagtcaaacttttatcataaggaggtcatggcaaatgcgttgtcaacattgtcaagtaaatgaagcaactattcgcctgaatatgcaagtgaattcatcccggagccaaatggttttatgtgaagactgctacacctctttgatggagcaatcaaaaatgaaaatgggacctcaattgttcggaggaagctcattcttctctgagcaagcaggacatacgcaaaacgtagagcagccaaaacaaaaaggcttactcgatgaacttggccgcaatttaacagatggcgcaaatgctggtttaattgatccagtcatcggccgtgatgaagaagtcgcaagagtcattgagattttaaatagaagaaataaaaataatcctgtcctcattggtgaaccaggtgttgggaaaacagcgatcgctgaaggacttgcactgaaaattgcaagtagcgatgtaccaaataaattaaagaacaaacaaatctatttattagatgtctcctcccttgtagcgaatacagggatacgtggtcaatttgaggaaagaatgaagcagttaatcaaagaactgcaaagccgtaaaaatattatcttatttgtagatgaaatccatcttcttgttggcgcaggatctgccgaagggtcaatggatgctggaaacatcttaaaaccagcccttgcacgaggcgagctccagctagtaggtgcgacaacattaaaagaatatcgtcaaattgaaaaagatgccgcacttgaacgacgctttcagcccgttattgtagatgagccaacacaagctgaagcgattgaaattttaaaaggcattcaagataagtacgaaagctaccatggcatcacctattcagacgaagccattcaagcatgtgttcaattatcttcacgatatatccaggaccgtcatttgccggataaagcgattgatttaatggatgaagcaggttcaaaagcgaacctctccattgatgccgcaagtgaagatgaactaacaaatcgtctgagagaaattgctgctgaaaaacaagccgctttaaaagaagaacagtacgaaaaagcagcgaagcttcgagatgaagaagaggccattgaagctagacttcaaaataaaacaaatgacaaagaacatgtcgtcacagcagaagacattcaggccatagtcgaacaaaaaacaggcattcctgttggcaaactgcaagcagacgaacaaaccaaaatgaaagaaattggcgtccgcttaaaagcacgagtgatcggccaagaacatgcggttgaaaaagtagcgaaagctgtgaaaagaagcagagccggcttaaaatcgaaacatagaccaactggctccttcctattcgttggaccaacaggtgtcggaaaaaccgaattgtcaaaaacgctagccgaagaattatttggttcaagagatgcgattatccgtttagatatgagtgaatacatggagaaacactcagtatctaagctcatcggttctcctcctggttatgttggacatgatgaagcgggtcaactaacggaaaaagtgcgcagaaaaccatacagcatcattttgcttgatgaaattgaaaaagcacaccctgatgtgcagcacatgttcctgcaaatcatggaagatggccggttaacagacagccaaggtagaaccgtcagctttaaagatacggtcatcatcatgacaagtaacgcaggcagcacagataaaacggtcaaagttggcttccagtctgatcaggaagaagcaattgaggagcaatcactcattgattcactcagcgcttatttcaagccagaattcttgaaccgttttgacagcatcattcagtttgactcattagatcgagatgatttagtgaagattgtggaccttctgctcaatgagctgtcagaacaattaaaagagcaaaatttaacagtccatgtgacaaatgaagcgaaagaaaaaattgcagaacttggataccatcctgcatttggtgctcgtccactgcgaagaaccattcaagagcatgttgaagatcaaatgacggaaatattacttgaagaagaacagctttcaggatttactgtagaagttgaagataacgaaattgtcgtaaaaaaaggataagtacatcttaagaaggatctacagctccatcatgttgcggtgtctaagttccatccgcacgccgacgctcccccgcctcttttcctttaagataaaagaaaaagaggtggatcacatgatgaattgcagctatgatcttgtcaaaatcatgtatgaggaaaaattaaaagagctgcttttaattgaaactgctcaaagaaattaaaaaagaaactccctttatatcagagggagtttcttttttaaggtaatagaaagcgctttcgtcaaaatttcttcacagaaactgccttaatttgatattcagactaaaacccttctagaagacaccgatattaactatagaaaaagatagttaaaggatttggtgagataatggataaaacatcgttaattggtattattttagcatttattgcactgagtgtcggtatggttttgaaaggtgtaagtctaaccgctcttatcaacccagcggctatattgatcattgtggttgggacgattgcagctgttgtcatcgcattcccatctagtgaaattaagaaaacaccaaaattgttcggcaaaattttcaaagacaacaagcttccaacgattcaagaaatgatccctcttttttcaaactgggcacaaattgcgcgtcgtgaaggtcttttggcattagaagctagcattgaggaagtagatgacgattttcttaagaacggcttaagcatggcggttgacggtcaaagtgcagaatttattcgcgacgtcttaacagaagaagttgacgccatgtcagaaagacatcagtcaggtgcattaatctttacacaagccggtacatacgctccgacgcttggtgtacttggcgccgttgtcggacttattgctgcacttgctaacatgggagatattgaagcacttggacatgcaatcagtgcagccttcgttgccacacttcttgggatttttactgggtatgtgttatggcatccatttgccaacaagctaaagcgtaaatcaaaggaagaagtaaaacttcgtctgattatgatcgaaggaattctttctgttcttgaaggtcaatctccaaaagtgattgaacaaaaacttctcatgtacttaccagcgaaagaacgtgcaaatcttgtcattgaagaaggagaaaaacaaaatggctaggaaacgtaaaaaacatgatcacgatgaccatgtagatgaatcttggctgatcccttatgccgatcttctgacgcttctgctcgctctcttcattgtgctttttgcatctagttcgattgatgcggcaaagtatgaacagatggccaagtcttttaatgtcgtctttacgggcggtactggtgtcatggatcaaaccagcatgcaaagtactgaagaaactgaaaatagcaaccagaccaaaaaagcagctgaagaagaagatgaagaagcgaaagcaaaagctcgagatcatgccgttctcacaaaggtcaaaaagcaagtggattccttcattgccaataagaaacttggagctaagctcgaaacaaagctcacggacgaaggtttgctcattacgatagaagacagtatcttctttgattctggccgggcggttattcgtcctcaagatgtccctttggcaaaggaaatctcaaaactactcgtcattaaccccgctcgtgacatcgtcattagcggacatactgataatgtaccgatcagaaattcagattttgaatccaactggtatttaagtgccatacgtgctgtaaactttttgagtattcttcttgagaacagcaatttaaaccaagagaactttagtacaaaaggtttcggtgaatttaagcccatcgcttcaaatgatacagcagaaggcagaagtaaaaaccggcgcgtagaagtacttattttaccgatcgagaaaaaagcaaaataaaaaaggaagccctcggcttccttttttatttattctttatgatcatataaatgttttgcacgcagtcccacatgtttaagcatgtcaatgcaggcatccttctcttcttcgctcaggacactgatcatctcatgaatttctttcgcatgatctgggaagatatcatcaagcaaagctcgtccctgctcggtaatatgtgcaaatgtgaccctccggtcttctgcacaggccttacgactgaggagttctttcttctccaatttatcgaccacatacgtgatgctgccgcttgcaagtaaaatcttatcaccgatttgctgaagcggctgatcccctttatgatacagtaattctaatactgcaaattcagtcggattcagcccgtgcttcacaatatgtttgttcatgtgatgattaattgagcgataggcacgtgataatacaataaataatttcaaagatttttcaacattatgattttccatttttttatcatcctttatgaaatgcaacccactaatgtgacattaataaacaataagtaaaatgtcaacatcttgatctatctttagcatgaaaatgagaccagaacgaatcacctaattttttaaaaatcacacaagtcatcgtaataaagataggttcaatgctataataagtctattaggtaatacgttggagcgatgaatgatgagtatattgaaagggttttggaagaagatcaggctgtaccttattttggtcatgattccaaccctaatcattagttattttatctacgaaaaagaaacggaaaaaatcgacttaaaaaacaaacaaactgctacacttatgttaaatattcacaaaaaccaaatgaattatttaattagtgaaacagaagcgagattaacttcacttgccatgggatttgaccagcctctcgagacgaaaaaggtacaaaacatcctagagaaaatctataaacaagaacctcgtttttcgggtctgtatctcctagacaaaaaaggaaatgtaacagtaagcaccacaccgttaaaggaaaaaatcaacctatcattcagagattactttaagcgcattcaagtgaccaagcagacggtgatcacagataattatgtgagccgaattacaaaacagcggattctttccatttgtgtgcctgtgctggatgaaaacgaagaagtcaccaatgtactagtcgccgccattcaaattgattatttaagaaatattatgaatgtattgaaccctgatcttcattttaagatgctgaatcaaaatggacatgtcgtgtttacaagtggtccacagccagcatcagaaaatggcagtaccgtgtctacatatttagatgaaaacagctggaagctggaggtctatccgcagcgtgcttctacaggtgaagtgctgtctgttatgctgatccccttatccagtgcttttattttattaaatattttattcacacttgttcaatatatcattttaaggcggcaaacccagcaggagcgtcaccaaaatgaagcgcaaaagcttgaattaatcgggaccctcgcagcaagtacggcacacgaaattcgcaacccattaacagggattagtggatttatacagcttttgcaaaagaagtatcactctgaagaagatcagctctatttttctgtcattgaagaagaaattaaacgaatcaaccaaatcgtcagtgagtttcttgtattagggaaaccaacggcagaaaaatggcagaataactctgtaaaagaaattgtaagtgagatcatgccgatcgttttctctgaggcgaacctttataatgttgaggttgatttgcaaattaatacgattcaagatgttggggtatattgcacaaaggatcacattaaacaagtcgtattaaatgtagcgaagaactcgttagaagcgatgccaaatggcggtcatttgaagattttgattgaggctgaaaaagaacatgtcattattaaagtgaaagatacaggcgagggcataccagaagaaatgttaaaacatatcttcctcccttttattacgtcgaaggaaaaagggacaggtcttggactagtcgtgtgtaaacgaatcatttcgatgtatggcggaacaattgatatcgagagcgaagtgaataaaggaacaaccgtcatgatcatgcttccttctgctcactcagcatagctgaaacattcagccggttttgcttaggcaagaccggttttttcatgtcaataagagggacggttcacagatagaaggctcatttgagagacaagatcatgaaaggttgcaacagattgtttctcatgaaaaagaagatactgatactcattcatcaggttgtccagttcttgactatatttaattgtcgtctcaccagtgtagccttctgcttgagcagcttctaccatctgttttctcttctcatcaattgacattagcaattgttcttttcttacataactattcatgatctcagctcccgcaataaattcgactgtctgtgctcaaaatgatccgacaccaaaattatactttatttgtaaattaaattaaatatgcttattttatttaattttttacagcctaaagacctcttacccaatcttatttgggggtaaacttcaaatttgggcaggactgacacatggattaaacagaattttatcctatgcagaagctcaaaatcaactattttctttctcattttatacctattttcctaaaaaaaagctgatcttccgcctcatgcggaatgatcagctcctgtcattaaaccgtttcttcctcgtaaattggcacccagccctcagttgtgacaaatatgcgaactgcgaccacttttcgatcctcttgaagtgtaaagtagtgacgaatatgcggcggaacagaaattaaatcaccaggattcagtctcacatcaaaaaagacgccatccttcccctgaatggcaaagattccatgaccgcttacgataaagcgtacttcgtcatctgtatggtgatgctcacgctgaaaattttggagcaagtcatctaggtttggtgtggcatcagataatgaaatcacatcctgcgctttgtatcctcgtttttcagatatactctcgatttccttttggaaaacagtcaaaatctcttccttttcctcatctgttaaatcatacttttctgctaatcggtttggcagctttgcaatatcccaatgttcataaatgaccccttgattttctaaataggctgccacctcttgctcgctttcaagtaatgtgttctcttcattatgaatcaaaatcgtcgccatgtgcttttcctcctttttatgtgacaagctgcttttgataaagcgttaattttaagtagtagctaaacaaaaattcatacgcctctaatactcgttttgcttcagaggctgtttttccccagactgtgatgccgtgatttcgaatgagcacagcacctgattccgactcttcagtgagatgctttgcaaattgtgctgcaagttgcggaatatgggctggattttcaataatcggtaatgatacttctgcatcctcttcccagaaaccaagcgctttgatgatttcgtttcctttgaaacgaacctcgcccttatccccatacagctcagagattacattattatcgattgtatggacatgcagacagcagcctgctttcgtccgttcatacacgtacgtgtgaagcagtgtttcagctgatggtctaagcggttggtcaggatcaacaggcttacctgctgcatttactaaaacaaagtcttcatctgtttcttttcgtttatctttgccgcttgccgtcaccaaaaacgtgattggatcatccgacaccttgattgataaattgccgcttgttccgtaaaaccagtctctttgtgccagttcacgtttgacgtcagctagctcctgccagcgcttgttctttgcgtctgccatttcttcacttcctttatttgatcaaattgtgctttaagatcaataaatgtttcaaactcttcatgaacaagcccgagctctttacattcgtttagcaagtagtcacgcgcaaatgtgagatccgcatgctttgccgcctccacatcggtgactgaatccccaatcatgataatgaagtcattctcactggtcagctctcgaatgattgacggcttgcagcagccgcagccattttgacactgcgaatcgcaggcatgcggccattcaatctgaatatactcttccccaaatgaggcatgattgcaataaatatcgtctctatccacaatgccctcgagtatgggataaacaaaaaaatccatcccgccgcttagcacatagaagggaatatcagccttttttacatgatcaacaaatggcttgaatccttctcgaatctctgtatcttctaaaataaacgattgaatggcttctttttgatcactcgtcagtaattgaaacatctgcccgacgccttcttgaatggtgatctcctttgtgagaacatcgtccttcagcttcgtccattcacttggtgcgaactgtttcatgatgcgaatgatattatcatttttcgtaatggttccatcaaaatcacaacatacaattggttttttcatttattctgctacccttccccatagttcaagtgctgcttttaagtcttggcaagaagcttccttctcttggatcgactctccatgtatcaccgcatcaatgatcgatcgaaatgctttccctccgccaatgcctccacgcggatggccgtgaattcctccgccagcatttatcacatgatcgagtccaaaatctttgatcaatactggaaccattccaggatgaatccctgctgacgggactgggaacgttttttgaaccgaatcctcttttacacaagcttcatagattccaaaggcatcttttttcggaagtgcgaccgacccatacggtgagggaaaaagacttaaatcagcgccagcatatcgatttaatttacctaaaagaagagaatgggagaatccatattcaggcgatgatgtcaaagcaccgcttactgcgggatgggccataataggcaatcgaatatctggatcctcaactaagctttgcatgacatctagcccgtaggcaaagacattgaataagagggcatccgctccaagctcagcagcctttcttgctcgatccctcagttcaaaggttctgcctgttaaattaacggcatatagcgttcggtgccctgtctcttcatatgtttcttttaatatcttttttccttctttgattcgctcttcaaaaggggctagcgggctctcaaataaaatttcatcgtctttgataaagtcaacgccgcctaatgcttgtaaacggagctgttcttttaaatctgccatatcacggccaatgacacctttaaaaatgctcatcaacaaaggtcgatcaaacacgcctgttttttttcgtatgccatcaattccaaataccggtcctggtaaacttcttttcaatctatctgaaaattgaatgtcgactagcttcacttttccatctagtgaaagctttccaaagatcgtcgtcaaaacggccggtatatccgctgaaaagttagcctcaggataagcaatggtcacctcagattgatataggccattttcggctggagcaaacttttctgataccttttctacccggcctttatgcttttgaagctgcttttttttgagctgcggcaaatccgtccatgatccaactgttagaccaagcgcgatctgctccgcttttcggttcacttgttcatcctctcgatgtgttaatacgtatgttgccagtaattcactcactaggaatcccctttcgattgcgtcatgcatatggtcaataaaaaaacctcttcaagtgctttatcagcgcctaaaagaggttgtttcgtgtcattcatccgaatcttatctctcagcgcttgctgcaagaattagcaccgtgcttcatggaagtcggttgccgggcttcattgggctagtccctctgcctactcttgataagaatattcaattttcttaaatattgtctgaattatcgcaccgtttattcatgttgtcaatggcttattttcaaacagattcaaggcatcgattcgccgagcggcttcttttaaccgctcctcatttgttaaaagtcctactctcacgtatccttcaccgtgagtaccaaacccattccccggtgccacaaccacatgcgctttctctaataatacgccagcaaaagattcagatgtatacccttctggcacctttagccaagcaaaaaacgacccctttggtgcagtgacctcccagccaatctccttgcaggcagcaatccacacatttcgccgattctcatatcgttcattttgcacctgtacacacgtttggtcgcttaacaaagcttccgctgctgcatcttgagtggctttgaacagtgaaacaaacaggtgatcctgataaagctcaatcgcttcaataacagatggatttcctgctgcaaaccctactctccagccggccatattatacgttttagacaatgtataaatttcaatccccgtctctttcgctccatctgtttgcaaaaagctgatcggcttttccccatcaaacccaataccgccataagcaaaatcatggacaacacagagcttgtgatcttttgcgaatgtaacggtttcttcaaaaaatgaacggcttgccgtggcacctgtcgggttgttgggataatttaaatacatcaactttgccttttccttaacatcctcaggcaacctgtcatagtcaggtaaaaaatcattttgttcaagaagcggcatcgtcaccatttgagctccagcaagcacggcacctgaccagtaatcaggataacctgggtctggaacaagaagtgtgtcacccggattcagcaggcattgcggcagctcaacaagtcccgctttcccgccaaataaaatcgcaatttccgtcatcggatcaagcgtgacaccatattctctttcataaaaggcagcggcagccttttttaatttcgctgttccgcggaatgacgagtattgatgattttcaggttttaataccgcttcctgcatggcttttacaatgtgcgcgggcgttggctggtcaggatttccctgccctaaattaatcatatctgcgccctcctgcacttttttctgaaccttttggacaagggttgcaaaaaattgtgtcggtaattgtttcagtacatctgaatgctggaattccatttttcttcaccttctattcaagttacatagcaatacaaacactgtaatggattgttttacgaattgtaaagcaatttcgaaaaaggattgacatgtgaagcgtagctctgataatatcttgaattaagaaatgcaaacaaacacgaaacaattacatattgatttctcttatcgagagttgggcgagggatttggccttttgaccccaacagcaaccgaccgttaataccactgtgaagtggggcgcagcaagtaagcgccaagacaattgtcttatagggcacggtgctaattccatcagacgtatgtgctgagagataagagaggctttgagtatacacaacatcaagcctctttctctcaggagaaagaggcttttttatatgatttggaggggaagcaattggttacacttacggcatcatatgaagaattaacagaaagctcggcagttgcactcgcaattagacttggcttgatccaagaaagcagtcatttgacatgtacggaaatcggtgacgggaatttaaattatgtctttcatatttttgatcataaacaagaaaaaggtttgatcatcaagcaggcactgccttacgccaaggtggtcggagagagctggccgcttacattagaccgtgcgagaatcgaaagtgctgccctgatcaagcagtcagaatatacgccgcacctcgtaccagcagtctattattcagatacagctctggctgtgacggcaatggaggatctatcacacctagaaatcgtcagaaaagggctaattgccggaaaacaatatccgcatttatctgatcatgtcggagaatttttaggaaaaacactattttacacttctgactttgccacaaatcctaaaatcaaaaaacaatttgtaaagcaatttacgaatccggacctttgtgacattaccgaaaagctcgtcttcacagatcctttctttgatagcggcacaaatgatttcgaagaagaattaagagaagctgccgaagcgctctgggcagatcttgcagtgcaggcaaaagcagctgaattgaagcgtattttcctgacatctgccgaaacattagttcatggagatcttcatacaggcagtatttttgcaagtgagacggaaacaaaaatcattgatccagaattcgctttttatggtcccttcggattcgatatcggtcactttatcgctaacctgttcctaaatgctttgtctcgtgagaatgaacatgatcaacagcacctttttgaccatgtcgtcaatgtatgggcgaccttcaaagaagtgttcgcaaaagcttggaaagaagacagcattgaagcatttagtgtatctgacagctttttagaaacaacctttgaccgtattttaaaagaagcgacaggctttgcgggctgtgagcttgtccgccgaacgatcggtcttgcccatgccgctgatctcgatgcaattccatcaccatctagacggattcagcagaaaaaagcagcacttacgctcggaaaaacattcatcaaacaatatcatgcagtggaaacagcgtctgacctcgtcgcattattccagcaatctgtaaaggagtgacgggttttgtctaaagaatttgaagtcccccgttctgtcgaatgggaagaaaaccattttaacattttgaatcagcaaaaattaccggcagaaaccgtatttgaacatctatatacaaaagaagacgtgtatgatgccattgtcacgttaaaagtgcggggagcacctgccattggcatcacagcagcttttggactagcgctcagtgcccaagacattgagacagaagatattgatgtgtttaaacaagaagtcattcagatcaaagaatatttaaacagtgctcgtccaaccgctgtgaatctagcctgggcattagatcgattattgcagcgcattgagcgtgcagcctcggtcaatgcagccaaaacagaccttgtccatgaagccattcaaattcaaattgaagatgaagaaacatgcagacaaatcggtcaaaatgcactccagctctttaaatcgggtgatcggattatgacaatatgcaatgcaggctctatcgccacgagccgttacggaacagcccttgctccattctatttagccaaaaagaaaaatctcgatcttcacatttatgcctgtgaaacacgccctgttcttcaaggggctaggctgacaacttgggagctcatgcaaggcggcgtagatgtgacgctcatcacagataacatggcagcccatacgatgaaagaaaagcaaatttctgcagttattgttggagctgatcgtattgcccgtaatggagatgcggcgaataagattggcacgttaagtcttgctattttagccaagcattttcaaattccgttttttatagctgcaccgctttctacctttgatgtctcaaccaaagacggggcagatattccaatagaagagcgcgatcctctggaagtaaaggaatttaacggcgtccaaattgcaccgcctgatgttcaggtattcaatcccgcctttgatgtcactcctcaccatctcatttcagggattattacagagaaagggattatcacgtcgaactatacagaagagattgatgctctgtttgctggaagcatctcactctgatcataaaaaaagcgccgtgtacttattatttaagagcaccgcgcttttttatttcattcgtttttgctaagatttcttttttctgttcttctgtcaaaacgttcattttgacacatagtgatgtgatggcatacattttattttttttgtcccaaaacattccgtagcgccctcctttttccctcaaccaacttttttagcttaataaaaggatatgtcgcttggaaaacatttggaacaggtcaatcgatttatttttgaacaaatgggataccttctaattcaagcagaaccgctttcatgtctgtcttcgttcctgcatagcccgttagagaacggtcttttccaatcactctgtgacagggaataaaaataggtaatgcattgcgtctgttggcttgtccaatcgctctcactgcctttgggttaccaatcgcttctgcaatgtctgcatagctttttgattcaccatacggaatagtcgaaagtgcttcccacacttgctcttgaaacgaagttcccttttgcttgagcgggagatcgaatacttggcgctcccccttgaaatattcatccagctgctttttcgcttcttgtaatacagacgtttcttcttcttttagattggcttcctgctttttttctaaaaacggctcatcatcaaacatcacctcgatgatggcatcatctttttctagtatgtataatgccccaattggtgcgtgatagacggtataatacacgttaatgctctccttcttgtttcttctgcctaagtggcagcgtgagatggaagacggttcctaccccttcctcactttctacctcaatggttccttgatgctcttcaataattttataactaaccattaagccaagtccagttcctctttcttttgtcgtataaaatggttcccctaaacgcttcagcttgtcctctgccattccgcagccttcatcccgcaatgaaatgacaatatgctcttcgcccttccgctgaatgctcacatagacatttccttttctcggcatgacttcaattgcattttttaaaatgttaataaagacttgttttaattggttttgttcacaataaatgagcggaatctcatccattacattgagatgcatttgaacgttgccaaggttcgcctgtgcgtgtagcagatccatcgtgtctttcacaatttgcacgacatttttttcttcatatacgatagcttgcggcttcgctaaaatcaaaaattcggtgatgatcgattcaattcttttgagctctgatgtgatgacattgaaatagagcgaatactccccttctatatttccttttaacagctgaataaagccttttaatgctgtcatcgggtttctaatttcatgcgcaattccagcggcaagctctccgaccacatgaagagtatctgattttctgacccgctcttctaattccttccgctctgtcacatctctaaagatcgctaaattcatattatgaataatgttacgtttaaaagagaattccaatatccgctgatctggatggttcagcacaaacggcacttcattgtccatttcatctaatgacatcgtctgggcaggctgtgccaaatgttcaatttgataaggcgcaaggatatggaatagattcatttccgttaaatgatcatctttcaacccgagcagctcgcttgcggatggattgacttcgataatgtggtattggttatcaaaaagaacaatgccgtccattgatccattaaatactttacggaatttgagctcactttcgcgcagctcctcctccatcctttttcgatcactcacattacgtaaaatggttaagtgctgtccttctaataccgcatgctttgatgtaaactcgagctctttaaactgaccatttgccattctgaacaaaagttcttcccttatttcatgattccgaatatatcgtcttctagtcggtctatatctccgatcagatttcacaagaaagtctgtgagttttttgccaatcagtgaatgcataggcaattcaaaaatgcggcaagctgattcattggctctcacaatctctccatcatccgcccatatgatgatcgcatccattgcattttcaaaaatttctctaaagcgttcctcactttttaacagcttctcttccattaaccttttttctgtaatatcccgcatgatggacatataaaaaccgctcatcacatttgatgtgatggtgagctcgaataatttgtactggccagattgaagggtaacgggaagttctcccttggctttccctgtttctttcagtgacgttaaaaggtgctgcaaggctggaagattttcatcttcgacaaattcttttaaataacgatcggttaaatccgtcttttgcagttcaaagctctgacaaaaagagtgattggcgtcgattatgcagccatcctgatcaaaaatgaccatgccgtcaatggctcggtcaaacaaatctttgaacagctgctcattcatggatcgttctcgttctaatattttctttgaggaaatatctcgcatgaccactatatattgctgattcaagacatcatgctctgcgacaaattcaatgtattttgtttcaccgttttcaagctgaatggaaatttctcttcttaatgttcctttacgaaaaaataaatcaagggagcattcaattttgtctttcgggatgccgtataggaaatctagaacggatttattgaggaggtcttctttcgatgtctgtacaagcctgcatgtcgcttcattggcttggataatattgaggtgttgatcaaatatgaaaatggcatctaacgtcttatttaacagcattttttgctgcatcaactctgttcgcaaatattcgttctctttttctaattttctgatatcttctgcgccatcgagcgtttcagtcattctcttacactccttttccagcctcattcctctacaatatttctacaatattttcattgttccttcattcgactcataaaaaaagataactttttacacgaagtctgtctcttttgtttcatttggatgacaggattgaaccgcgattctcttttcttacgcttcttttacaaccgttctacaatttcacatcaaatagcgaaatgagccaaaatgtattttaaaatggggcaaatacgggaacagtgcacttagaacatttatggttgaaatcaagcaggaaaggtgatgttatggcatcttcacgagatagttattttgataatgcgaaatttcttctgatttttctagttgtttttggtcatttgttacgatcattcattcatgataatgattggatactttatttatacaagtttatttatacttttcacatgcctgcctttattttggtttccggcttctttgcaaaagggtttagaaagccaggttttatgaaaaaagttgctgttaagctgatcatcccatatttcatttttcaggtgatctattccgtttactattatctcttacaggatcaaagcatggccaatttaaatccaattgatccgcaatggtctttatggtttttaattagtttattcttttggaatttgctgctcattcctttttctaaactgccatttcactgggcgatgatcgtcagtttgtcgattgcgttacttgtcggttacgtggacagtattagcaatacgctgagcttatcacgtacgtttgtctttttgccgatgtttttagctggcttctatttaaaaaagcagcattttgaattcatccgtacaagcaaaggaaagctggcagcactccttgtattaatggctgtattcttgttttgctatttctatgaatttgattattccttcttatttggatcacagtcatatgcttctcttggtgatgagggagtgattgcggcaatgaaacgaatggcatggtatctgcttgcattcggcgctacattcagcttctttgctttagtgccaacacgccgtttcttctttacaaaatggggcacaagaacgttatatgtgtatttattacatggctttgttatcaagcttcttagaacgacttggtttgatgactgggccctgaatgcagcaagtgtgctcatgttattgctgctgaccattctgcttaccttcaccctgtctagcacatttgttaaaaccgttgcacagccagtgattgagctcaaaatgaccagtctcacgcgtacaatcaccggcagacaaggcagttatagcaaataaaaaacgatcctgagcggatcgttttttctatttttcattcatatgtccattgtggcattcatcatctttcttaggttttacaagagtatcaatccatttgctgctgttgatatctccaagctcactgccaaattcctcttctaagatatctgggtccattggctttttatggtctttcatgtccttgctttttacatgcttcttagtcacgagatcctcccccttgcttccctttatgagaatttcgatttgcctgacggtctcttgattgttcatcaaattgggtttgtccttgatcatgtgccatgctctctgtcggtgtcatattatttgtcagtgcttcgtttttcgctgcttttcttttcatttggaatcagtccttttttaacatatttagttcttctcttaattggtctagaagttccttcatttgtttgaccgtcacaggcttttcctctggctttaactcatagccgatttgtccattggcttctagggtggcttttttgagactgctgatctctgtaatgccttgctgctttaaccgcattttaaattgatctcttgtaagcctcgttttcttcagcttgtgatcaagcagttctccgtcttgtagaatcaccaccgatttccctgaaactaatttttcaaagaaatcagattgaatcgacagcttctccattatgacaagcgccacaataaagatagcggctgcataaatggtttcaagtaaattgtgctctataaagggttggataataatcgatccgattgaaatcataatcactgtttgttgaacagttaattgactaatggatttaggccctgctattctcagcagtaaggtaccaactagcagcataacaatcgctttccataacacatccagcacgtctcgttcacctcttacctatagattgcgaacatcccatgtgatttagccagttagataatggaaataaaaaaaacagcattcgctcggaatgctgtttagccgatgatgacacgctctttcggataatgataattcgcttcgctttctcttcggccaattaaatataagaagcttggaatgccgattcgcccaataaacatgaccaccataatgatgcactttccgaaaacagagagctcagaggtaatccctagtgataaacctgttgttccgaaagcagaacagacttcaaataaattttgaagaagcgtattatgctcagataaggttaataagaatgtagcaccaaacaccaatataaaggccatcatcgtcaccataagagatttgttaatatctgcttgatgcagctctcttttgaaaattttaatggacttatttccccgagcaaaatgaaacagtgcaagtaaattaagggcaaaggtggttgtccgaattccgccccccaccgagcttggagatgccccgataaacatgagcagacataaaaataacagcgttggttctgtcaattgagtaatatctaatgtggaaagtcccccacttcttgtggccgtcgattggaacaatgaataaaacaaaacttcgtgccagctcttccctaaaaacgtaaaccgggcttcaagagcataaatcccaatagcaccaacaatgactaagctgccaaacgtaatcgttgtgatttttgtaaacaacgagaacgatgcgtgctttcggtcctgattaaataagtaatcctttacttccacgagcacaggaaagccaatagctccaaagatgatcagcagcatcgtaataaattggacgaaataatcatctttgtatgggatgagcgagttccctgtaatatcgaagcccccattggtggtcgcactaatactcgagaagaagccatgtaagaatgctgtctgtacatcgtaatatttgagaaaatacatacttaaaatcagaccgcctacaaactcaatgagcaaaattaaatataagacctgcttcattagtttcacaattcctgataaattgctctggttttgatctgccatgatgagctttctttctttaatcccgatcctttttcgcatgacaatccacacaaaggtaccgagcgtcataatgccgatacctccgatttgaaggacaaacgcaaggatccacatacctgccacactaaatgtttgcgaggtatcaaccacagtaagtcctgtgacacttaccgcactcaccgccgtaaataatgcatcgataaatgtccacttcaccccatcttgatgagcgactggcaaactgagaagaataaatgagacggttacagcgagaaaataataaagggcaatcagctggaaagccgatagccggtcaattagctttttaattgggttcattgtcattccttcttttaactttcatttttcaatacttatcattttaatgaaaagagacatgattttaaagatattttatgctttatttactttttcatcaaaaaagaaaagacatcctgtaacagaatgtcttttcgtctctcttattttgcttctagtcttctaattctttcgtttaaatcagggtgtgttgagaaaagagaagcttttcgtttaccactgattttaagcgtagcaactgctgtttgatcatcatctttgattcttgacgtatacgcctcaagtgagcgaagcgcatgaatcattttatctttaccggcaaggtcagctccgccgcggtctgcatggaattcacggtgtctagaatatgcaaacacgacaaggcttcctaggacagagaaaatgatttggaaaacaatcactgcaataaaatgaacaatcggcacaagctcttcacgcggaacaaagcggcttgcgatccatgccgcaattcttgaaaggaagacaacgaacgtgttgacgatcccttgaagcagcgtcattgtcaccatgtctccgttcgcaacgtgagcaatttcgtgagcgatgacaccttcaactgctgcatcatccatttcatgaagtaatccagtggaaaccgcaacaagtgatcttctcttagaaggacctgtcgcaaaagcatttacttcagatgattgataaatcccaacctcaggcattttagaaaggcctgctgctcttgataatctgtgcacgcggtcaacaagctgctgctcatcatatgttaatgaatccttttcaggatttaacacacgcacacccatcatcatttttgccatccagcgagacatcgctagtgacatgaacgagccaacaaaaccaacaactgcactgaatactaacagtgccacaaaattaattccaccgtctgctcctatataagaaccaacaccagttgctgcactaataaccgacagtacaataccaatcgtagtgataacaagaatgttcgttaatataaacagaaatattcttttacccatacataacctccgctgtcatattaagttcatttgaacttattaataaaattataaaaataaacgtctcaaattgcaaggaaaaaggaatcatttcctctatttatcataacggcttaagccccgtcacttcaatatttacgacataagccacagctgaaaagtgaataaattgtgacgccgctttctggattttagtttattttgcatttttatcaaaaagagattatgatgttgaattagataaattatgacgtttttgacatacaaacgaggtggaacaatgggtgcttttaaattaacgagaattgacatgacaagtcttctttattctctaaaaggagagggagatctgactccgcttcagctattaaatttatctgtaaaaaaagacaaacaacacgaacttgacgagctcatcatcccttctttttttgagaggcttgaaaggcggaaacaaaaatcagagcatggactctccacaaatgaaattgtagaattaggaaatctatgcgaactgacttctcttaaatcgacagcgattcaaaactggatcaagcgtgatattaaagatatgattggccaccctgagcttggaaagaagtactcaattgatcaggtcgttattttattaattgtgagagatttaaaatcagtttttgactttgatgccatccggaccatcttatctgccttatttaacacgattacggatcgaactgatgatattattagtccactgcgtttttatgaagcatatgcgcatgtccttgattttatttatcatcatactccttttccgttaaaagaaacaaacttacgggaaatcacagaggaacagacagataagctccgtgaagaatttgctgaattgacgcagcatcaatggcatttgatcaaaggtattatcagttcaaccgttttttctgtctttacttcacacttgcaaagtacggcacaagaaatgatgtttcatacactgcagcatcaggattaaaaaagaaccgaggtgaatcatcacctcggtttttttgtacagcaattgccagcataattacatgtcgttttcttcaaaataagaaggcgcaacaaacataaggtgaaaggaggaatacggacatggcaaatcgaaatcaacttcttgttcctggagtagaacaagcattagatcaatttaaatacgagatcgctcaagaatttggcgtgactctcggttcagatacagtcgcacgtgcaaacggttctgttggcggcgaaattacaaaaagactcgttcaacaggctcaatcacaaatgggcaatcaatctaaataaaaacatggtgaaatacgccggagctattctggcgtttttttattgctcatatgtgtgctcatagcggttctcacgatacggggacggtgcaccttttccttgcttcttcacatgttctttttttcgttcagcggacggctgtttctgatccctgtcgtttttttttacgtgcttttcagcaccaccacgtgatgtgccgtttggactccttttgtcatcaggttccgttgagtgattttttttttgttctttatcgatagaacgatccttttcttcctttatttgattgtctttgcttttatcatcaggttttgcttggtgaggcttttgaatagatccttgctcttccctctcttgatccttctgctgttcgtcttcagcttcaggagcctcttgatctggcttcaactcttcgctatcgtctgtcttgacgtcttcttgtttgtctttgtctgcttgatcttcatcatcttttttaggctcttcttctttgacagcatcactctctgctgcgtcttcatcctgttgaatgtcttcttgttctttgtcttgcatttcttgatttctgatatatgtgcctgttgaaatgcctgccttttgagctttttctcttgtttccaggtcactttctacagtttctagcttgtaatcgcgcttttgatattcaccagagatggtgttaattttacttttgacgttggttttatatgtatggtcctgcttattttcataaaccgttgaaatataaatgctcttagaatggttcacgtaaccttttttgtcacagtcatctatgatttcctgcacgactttggtcatgtcgtttttttctaaacccttcatactggccagtacttgtttcgcatctttattcagtggcgtgacaccgatcacttgataattgtgatcaagctttagttcaaagcttggattaatgtcaatcgtcatatatgcatatgctttttgacttgagaacgatggcatcatagtgaaaatcacgacaataatcgctgcgattgataggattcctgcatttaatggacgtaaacgaagcaagtcaaaaaaaccggctttttttctttcgagacgtgattcattcggaaatgtcacttcttgaccgatttcataatcttgctgttcatattttgtccgcagaaattgtccatcaggggtcagcagcgtgacatattttttgtttttctctactataatgcctcttctcatgaattaagcacccctttaaggtaatctttcaaatacacataatcacccgtcataatgatcgccatcgcaatgatatattttctatttctttcaatcgttttgcggctgacttccactagcttttcaagctgtttgactggcaattgttttttctgaaataaaatggttcggagctcatcgtgttcaacgagtgtgtgggctactttaatggcattttgcctggcatctgcatgctttggtgaatgttcaagcagctcttgaaacgtgagaccgtatactttcaatcgttctttaaaatgttcaatttcttctcttctgtgttcttgttcaattaaacgtctatattcgtttgtagacagctctgcttcaatcatgctttgagagtactcgccattttcactttcttgcaggtccatttgaaccgttggcgcatttctcgcttcttttcgaatatagtcgatcacttttcttttaataattaattctgcgaaagcaaggagtgagtttcctttttcggcagagtatttttctatcgcttcattaaaggcaattaagcctatgctgaattcatcatctttttcatctatatatcgtttacaaacggatgaaaccgtcttagcgacaaatggtttgtattgctctattaatgcattttgcagctcgatatcaccttgttgaatactaatagccgactgctctaatgtttgctttttctttccttttttaaacaaaaggctaagcaatggtttcacctcagttctccctatattactcatttatgatagctaatttatgagggaagcgcaaaggaagaaatgaggaattcatttcctgttactcaattgtgacatgaatatcatcatctactttacaatgtttcgtctaaaagcaaagaaataagggggtatctcccccttatttgtaatatatgtgttatgaaaatgaaatgatatttctttcaaaaaacctactcttctaggcgcccctcttgtttttccttgttttgttgcccgccttttcttgatggacttgataaaaaccagccaaatgctgcaattgcgagaagcactgtccagaaaatcactttccataatgttgaatgaataaaatgagaggacacgataccaatggctggatgtgacagtgtataaagcgtgagcttcacaccaacccatccgacaatgacaaaagctgctgtttctaggctcggtcttgttttgagcagtttcacaaagacagtcgctgcaaatctcatgatgatcaaaccgatgataccacctaagagaatgacaataaattgaccgccatcaagtccaccgatttgcggaagacttgttttcggcaatgttacggctaatgcgaccgccgctaagatggaatcgacagcaaaggcgatgtcagcaagctcgacttttacgactgttgcccagaagccgctttgcttcatgtttgtgtctgattcctttttcttaaatacgtgcgattttaaaatatggtgaatggaaatataaagaagataaattgcaccaatggcttgaacttgccacacatctactaaaaacgaaataagaaacagggagccaaatcgcatgacaaacgcacccgcaagtccgtaaaacaacgccttttttctttgcttttcaggaaggtgtttcaccatcacagccatgaccagcgcattgtcagcggctaaaatcccttctaatccaatcagtacgagaagaacccatccgtactctaaaataattgctgcatccatcatcattcctccttgtttttatctattgtcccacaacagacaaaggcttatgaatgcaaaaaagacctttgcctgtaatggcaaaggtcttgctagacatgtgatatgtagaatcatgccaacaaagccgatggaacttaagtccatgtaatgacgactttgtttccggtaaaaaccggacgctactcccctttggtgggatttaagaatatttagattacttatattttaatcaatagacactgtattgtcaacaggtgactttcacctcgggtccagtgattaggcagttggtgtttctgcttttctttttctacgtttcatccatatatacatcgcgaaaagcaacacaatcccgatcccaatcggcagaagatatggatctaacattgcgccaacctctttccagttctccccgagcacaaatccaagatacacatatacaaatgtaataggcgtaattgctaaaaacgtgtacaggcaaaagacccacacattcatcttggcaataccgcacgggatggaaataagcgttctgactcctggaataaatcggccgctaaatgcgacgaatccaccatgctttttaaagaaggcatccgatttatcaagtgactccggtttaacaaaaaagtacttcccatatttatttaaaaagggtctgccgccataacgtcctaaccagtacaaggtcaaaggaccagccacgccgccaatagagccggctgccacaacacctatgaaagccatgtccccttctgagacccagtaacccgcaagaggcagaaccacttcagcaggaacaaattcaatacataatgctaggaagatgccaaagtacgacaagttcttaaaggcatcagctaaagaaataataaaatcttcgatgtttatcaatccctttcacacataatcgtttaactgattctatctcttttagaatcgcacatatattaaacgaataaaaccgaagaaacgattcacttttcgtcgtttttttacattaaatttgattttactataaaagacaagtgaagaaaacgttgattgtggtatttaagtgaaggaaaagtgaacacagaagccattcgatccgatatattaagtatacgtctgttttaagatactggaggttttcttacatgacccatttaacaggaagctacaatggatggcttgtctttctgtcaatcgcagtcgccgctgtcgcctcctactcagctcttcatttagccagccgagtagcacagtcaagcggtgcaaagaaaaaggtatggctgatcgttggtgccatgatcatggggatggggatatggtcgatgcattttatcggcatgatggcatttcacatgcatgctggtatcacatatgaaacacccttgctcattttatcgattttggcatcttttgccgggtccttgatcgcattcacaatatgcattcaagaacagctctccacaagacggctgctcattagttcaatcaccttgggctcagctatttgcagtatgcattatcttggaatggaatcaatggccaatgtctccatcagctatgatccagtcctcttttttctttcgtttttcattgctgcgatagcgtctttcttttcgcttcatctcttttttcggctccatcgatccgggaaaaaacaggaggatcatctgttaaaaatagctggtgcactcgtgatgggcggggctgtttctgggatgcattataccggtatggctgcttctactatgttttttcattcagacggtcagtcctctgggggtggttctcttgaattatcaccattcagtctgtcgattttcatcggccttatgacactgattgtccaaacactgatgatttttggtgcctatatcgatcaccgaatcatgaagcaggcagataagctaaaggaaaatgaacagcggttccaatcgctcatcaaacataatatcgatggcattatcgtgttatcggtcaatcgaaaggtgctttctgcgaacgactcaggtaaacaaatcctaaaaatgtgcaattcatggattggtgacgatgtcagtcaatacgtcatgccaactgacatgtgggaagaatttatttgcgagtcaaaaaaagccatcacacgtgaagcagaactaaaagcagcagatcgcttttattattatcatgtcacttacatacctgttcatgtcaacaatacgcttgacagtatttatcttgtcttaaaagatttaacgcagcagcggattgcagaaaaagaaattcatgtcatggcacattatgatgcattaactgagcttcctaatcggcgccatgccatcaaccatttaagtgatgttctctcggctcaagaagagacaggaacatcgacagctgttctgtttcttgatttgaatcgttttaaaattattaatgatgcacttggtcataacataggggacttacttcttaaagcagctgcaaacagactgacgaaatgtttaccagacaacggctttatagcaagactaggcggagatgaatttttaatgatctttcctgacatggggcatcacacacagaaaattgaacagctttctcaaaatatcattcgtcaatttgagcgtccttttttcatccagaatcatcagctcattacatctatcagcattggaatcgctatctcacctcagaatggcaaagatggaatggaattaatgaggaaagccgatatggcgatgtatttatccaaaaaacataagcaaagccgttatgagtttttcaccgaatcaatggaaagatcaagtgaagacaggttgaaccgagagcttgagttacgggatgctattcaaagagaacagtttgtgcttcattaccagccgcaagtcagtgcaaaaacaagacagatgactggcgtagaagctcttctaagaatgaaagcaccagatgggtcgttaaaatcacctgaggcttttattgagctggcagaggaatcagggctgatcattgatattggcagatgggtcattgataccgcgtgcaggcaggctaagacgtggtatgataacgggctgaaaattcctgtggctgtcaatttatcagcgaaacaatttaattctgaagacttaattgatttgattaagctgacattaaaaaaatacgatctgacaccgtcactgcttgagcttgaagtcacagaaagtatgacaatggacaatattaagcaatcaaaacaggtgctgacgtcactgaaacacctaggcgtccgcattagtattgatgactttggtacagggcatagctccttaagctatttaaaggatttgcccattcatcgactgaaaatcgacaaatccttcattgaagatattttacatgattcgaaatctgaacagattacaggtgccattatcgcgatgggacatcaactttctctcgaggtcatagcagaaggtgttgaaacctttgcgcaggcgcagcttttatctgcgcaaggatgtgacgacctgcaaggcttttattatgcaaagccccttccagcaaacgatatcgaaaaattcattgcctatccagcgcatcagctggacacataaaaaaggtgccaatcatggcaccttttcgttctatctaaataataaatgttgactgtgaatacctgcttttttcaatagactaatcaattgttcttgttcttctcgcgagaggcctgagaaggcacgcgcaatccgcagagaatgaatcgggtaaatcttatcaagataactgcgccctttatctgttaaatgggcataaaccgaccgtttatcctttgggtcctgctctctttcaataaaaccatttcgttctaatttgtcaattacgtacgtcacattcccgctgacaagcaggagtcttgagccgatttgctgaagtttttgagcacctcttgtatacagcaattcaagaaccgcaaattcagttggattaaatccatgctctttgctgtctctaatgctgtgttctgaaacgcttttaaatgctcttgcaaataccttgtaaagtgtcattgcacgttctacttcttcttcattaaacgatagtctcatcacatatctacctcttataatatttttttaacttcaaggctttcttgcggtgcagttggagcctttcgtaaaaaatagaagtacgtttttgaaaaccctttcaaccacataagtgactccattcgtgttatgtataagatttcgatataaacttttaaaatccttcttatttttcacaaccatctcgaaaaaaaggttttttagcaaaccatcaagatacgacatagtttaacataatctgtaaagactctatgttttcttacactgcattcgtcaaatttctacaaaattcaatattgctataatattaaacaaaaaagaaccccttatgtgacatgcgcacatttcaaggggattttcacaaatcacgctctgttttgttgaaaaagaagtgatactctttttttaagtcactaattgtcatgttcttggccgcactaggactgtacacgcccaatgaacagagctgcttcgtatagtaatgtctttcctttgctaaagcttctgttaagatacgccgcaccgattatcccctcctatcaattgatctggaccaggtgcttatgaagaccttttatacaaatcattttgtacggctcttagaagagcatgtgcattctgacctgccgcctgcatgaatcgctccagtaattcatccctctttatatctaatgcgatgatttcttttgccatacagatgatccgtgtttgctccatcatatgctcctcctcctatttcaactcatcatcattatatgcatgcgcagcaatcatttcacatctgttgtaaactttccttccattgttttttcatttttatgtttttgtgttatattttctaacaaacgatgattttttttcgttgtcattctgtataatatgaagaaaaaacttgcaggggtgagtatatgacgcaggaagatgtatcatataaagataaaaaagtcatttcaatcgggattgtcagtgaattaacagggctatccgtcaggcaaatccgatattatgaggaacgcagactcatctacccccagcgctcaacaagaggcacgcgtaaatattctttttctgatgtagaacgtttaatggatatcgccaacaaacgagaagacggtgtgcaaacagcggagattttgaaagacatgaagaaaaaagaacaggcattaaaaagcggacaatataagaaaaaaatgctggaaggtcaaattaacgcacacttccggtacaaaaatcgataaacaaataaagtatcgctgactcttttaggctttttggtcatggcttcatgaaaaagagacagcttttttgctgtctccgttccatttacggcttagagctattttagttagagtatagctttaatagttcttgtgctggcaaactatttgtattgttcatgccattaacgcgttataaaattcattcactgctttatccccttatttattacttattccaacaaactttcaacattatcttaatttgagcacaatgccaaatcctattaagtgaaataagctatataagcaaggacatcagttttaatttacttttttcaggcggcgttcaataacatttcattctaagaaccaacactctatcaaataacgtttagtatattgttaagtgcagtcgatctagcgttcatccattcgttcaggaatcgaaacagttcgttcattgaccacattgcccgtgtttagcgtcgtttttggttcaatcaagagcaaatgaacttcttcttcagcaaacggctgatgttcaattccttttggaatcacaagaaactccccttcatgaagcgctatttctctatccctaaaacggatgactagatttcctttccatacaaagaacatttcatcctcgtcatcatgatgatgccaaatgaattcacccttaatttttaccattttcatgtatgagtcgttcaactctccacttattctaggattccaataatcatttatttgcgaaaatttctcttggatattaacctttgaaatcaataaattccctcctcatttacttggaaacgtctttttttatctttcttaagctaaaactccctaccttgcaaattctcctcctcatgataaacatcaagggacacaatgagcatcaacctcttatattattaagtttacttattctattggatcacgtaaaatcaaaaaatagtgtatagttcatcacaaattgtgatgcaaaaaggagcattattttggatattacatctttggagatatttaaagcagtagctattgaacaaagcattacaaaagctgccgagaaattaaattatgtgcagtcgaatgtcactgcacgaatccagcgtcttgaacaagaattaggtgttcctcttttctatcgatatcacaaaaagatatccttaacgcctgcagggcgagaactgctgccatatgcaaacaaattactctacaattttgaagaagcgatagaggccgtaaagctttcctctactccgcgaggaactttgcacattggatctatagagtctaccgcttcgacaagattgcccagcattttcgcagcatatcacaagacattttcacaagtagaattaagcatgtatatggcacctactgtagatcaggttcatgctattctcaactacaaggtagacggtgcattggttgatgggcccattcttcatcccgacattattgaatatccggtattagaagaatcccttgttctcattacaagctactctgaggaggaattccaggtagaatcaattttacatgaaccattgctttcgtcatttgcgcattgcatctatttggggcgttggcaacgatggttagagagcaatggctttgctccgatgaaggtaatggaatatggcactttagagggcgtgcttaaatgcgttgaaaacgggctaggggttaccgtattaccaaaatctatggttgaatctcggatgcaaggcagatttacctgtcatcctttaccggaaccacatagaatcgtgcccactgtgtttataaggcgtcgcgattcgtacatgactagtgccctctcacggtttatggaattattgggcataactcatatatgatcgggtcatttatggtaaaaaagaggatagatagagcgacattcttccagctcttctatccttttcaataaaatcattttagcattcattgagaggaagcgtcagttccttcaacgagccctacaaagtcaatccgtacaccgcctttttcaggatcttctatgacccgcatggccagcgcctttttctcccctgttttttcatcttcgtaattcgcatgaaagacatgaatgctggcttcttccaattgaaaatcatcataagaaagtgtctctatgccccattcttttttcatttttagaatgtcattcgaacttgggacagcgccttcaacatagatattttctatttttcgtttatttccttcgctaatagcttcaatcatatgctctgctgccaccagtcttctgtctttcccctcgtcttctcttgaacatgcacctagcaaaacaatgcacattaaaatgaataaaaacttcttcatttttctctcccaccttctccttaaaatgtaaaggatggaagcgctatatgcaatctttattcaaaaaagactgtaaaacgtcacgttttacagtcttcatgctacatcagtgtatgaaggaatgctgttgcaattccaaaatagatcagtaaggataaaatatcattcaatgttgtgatcagcggcccagatgcaatggccgggtccacatttaatctgtgtaaaataatcggcacgaccgtacctgccattgtcccaataatcagtgttgcaagcagcgaagaaccgacaacaaaacctaaaatcatattgccctgccacaccattgcgacaactgtaataataatggaacaaacaatcccaatgtaaatactcgttctcagctctctaaaaataaggcgcataatggtttttttcgttaattcttcttttgagagccctctaatgacgacggcaagagactgtgtccctgtattacctgtcatcccggcaatcatcggcatgaaaaacgctaaagcaacaacttgctgaagggtatcttcaaaataatttaaaatactgcctgaaatcagcccaatgaacaagagcaaaatgagccacggaagacggcggtatgccgccacaaatgccggtgtgtcgaacgtgatatctttaccagaggcagcaaacttttcatagtcttcgcctgcctcttgaatcacaacatcaatgatatcatcaactgtaacaattccgactaggacattgttctcttccacaacaggaatcgcaaggaaatcatatcgttcaatcagctttgcgatttcctcctgatcctgaaaggctccaacggcaatgactcttgtaaacatgagatcctgtaccttttcatccggttcacctaaaatgagatcccggtatgagagaacgcctacaagctgtttttgatcattaatcacatataaatagttgattgattccgcgatttcagcaaagcttttcagcttcacaactgcatcctgtactgtaaaatgctgaggaatccaaacgtaacggttggtcatgatccgtcccgctgtctcagcagggtaattcataagaagctggacggccttggattcctctgcttccatgttagataatagctgatcctttagctcatcctccatctcatcaaacaagttggctagatcatcgttatccattttgtttgtgacgaaggtcgctttgtctttccctactttttcaagaacgatttcttgatattccctctccagctcacccatcatttctgtcacgtcatcgactggtaaaaagctgaggaagcggctgcggtgtttctctggaagttctttaaataagtaggccatatcatatggctgaagttcttccataatgtttttaaattcttttcgttttccatctcttagtaaaataatgatgcgtaaaatgagttcatcgtacgttatattttgtatcatcgctgttacctccccaaagtcaggagatacccgaatcccttagaatgtgcgggggtcaggatctcctctatctgatgtctcaatctgatcttttgacatattctctatgtgtctcgaatcgggatgatccatccccacacctccttttcccataaaaaaacaccttcaaccgaatgaaggcgctttgtaagcatgacaaataaacacttgctccttcaatcgtagagctttagcactgtatggcataggaaaaatccagctgcattaaaaatcaccttatgtcgatgatttctgttgacccattggcgtctttggacatttttgggcagcagcgtatctccatacaggagcctcacctaacgaagtctcatattgttgacacactgagattacagaaaaagcgcagtgatgtcaataagcaagatgccaagttcctttatgtattcgcttacatttcaaaaaaagagcgatagacaaagtagaccatcgccctttcatgtctttattcctcttctggctgattcatatcctcttgggagaggagatgaaaggaatcatgcaaaaacaaagcatatccttctccgtcaggatgcggaacatattccgcatggtccattgtttgctcttcttcttttttcttcatattctctcgcctcctttcccgtagtttgtcccaatgcaaaaaccttacacatgaaagtgtaaggtttcgtgatggcttaatcatcccattcttgctttaggattttgcctgttttagcggaaatctcaaaatcaacttcctcgccttttggtgtggtgatttcgacttcatataagtacacaccattttctttatctaaatcagaatctgtgactgttccttttacttttgcaagggcaatttgttcagcctgctttttagtaattttcacattctgtttcttttctttgactggatcgttcagcgcttttcctgttttggcatcgacatatactttatattcaaaaccgccttttttaatctcaacctcatacacccattttccttttttacgctcaagatccacatcgtccacataccctttcaccacttttagggcagctttttctgcttgtttcttagagacaaacgaagatttcttttgcaccacttgctccgcgtgtgctgtttgatttgtattttgcgcttgaagtgtgaaaccacctgcgacaagagttcctgttaatgctgtagctactagtacttttttcatcatattcatatcctcctctatttgatttctcctttatcttaaagaaacaagatgataaaggaaggaaagaaacatgagaaaatcatgagaaaaggattagttttcgtacgtaattccttcaatatctcctgtatatgcgtttacaagtacctctgcctcccgcccatcaggcaaatccagctccacctcaaatacgagcataccgctaaatgtttcaagatcagcatcatccactgtccctccgacttcttttactgcaattcggatggcttcttcgaccgtgatttttgtcattttcttttctttagaggtcgggtttttcttttctgcttcaagcactttaaacgtttgcttgtcaacatcgacttgatataattctttttttgattggattgaaaagatataacgatcggacttttctttcttttgaatgaccgtaccgctcacctttttaacagccgcttcttctgcttgaagctcagcatttttttcatttggtttttgatagctctttatttgtctaatctctttcatttgaccgcttgcggaagatgcaatgatttgataaatgccatttgcattttccagcgtcaatgtatagtcctgtttatgattgattaaatcaatctgtgtaatgtttccattgtagtcttttgcaatcatttttttgatttctgcttcacttaatattttttgatcaatggtttgaatcatgagcattgcaaaggccgcaagaacgacgagacatcctgcgagcgcaagcaccattttcgtttttctagacatgcagcgcctccttcctatttcctattttataaggaggaaatgagaaattgatgagaaaagacccatttattttgagaaaagaatggtcatggttgtccctttgccgattcggctgtctaccttcagctcagctccatgctcttctgcaatttgcttcgcaattgaaagaccaagacctgttccgccggtctcactgtttcttgcttcatctacacggaaaaagcggtcaaagatttttgggagatcctcttcttttatgccaatcccatggtcaatgactgaaataaacggcttctctcctctccatccgcaggtcacatcaactggctctgtactatatttgaccgcattatcaatcaagatggtcaaaagctgtttgattttctcttcgtctccttccgcaataagcggctgatctgtttgcacacgagattgaatcgttcgattagtggccacttcaagtgtatggcaaagctgcttgcacaaatgaccaagatcaactggcttcatatccacatatagcggctgaccatttttcgccagtgtcagcaattgatctgtcagtcttttcatttttttcgcttcatcatgtatcgcttgggaggattcttctataacctctggacgtgtttgcccccagcgcttgagtaaattgctgtagctcataatgaccgtaatcggcgtcttcaactcgtgtgaggcatcatgcagaaattgctgctctttttcataatgcttctcgaggatttctgacatttcattaaaggtttggcccatttgatacaattcatccttagaatcgcctgttaattcgattcgtttaaacgccttctccctcatactcgccttcatggtactcgtcattcgactaatcggccggacgatttgttttgttaaaatatggcctgcaaaataagaaagcacaataattaaaacacccgcagcaactaaaatcatttttaataacgctaagttctcttccgtattttcgatttcttcatatacttggagcgacacaatctcgccatttgtccaaataaccggaatcgcagcgaacgcaaccatatgcttgttgtattctttgatttctgctgtctgcccagattcatatgtaaaaggcagtgaactaaacgttgactcctttgtgacagtcagctttgattcacccgtttctgtcacgacacggatcatgccattttggggcaggtaggctttcagcagctctgatgatggaagaccttcttcttctgatttttttaaagcaatggcgatattttcagccacctcagacagccgggacatatctttttgcgtcaaggtgattgaaaaaataaaataaatggctgtatggaataagagcaccattaaaaacaatgacaacgacgtataaagctggatcttattttttaatctcattctttatcctttcatcacataacccacacctctcactgtgtgaatcagctgtttttcgaatgggtaatcgacttttttccttaaataacgaatatagacatccaccacgttcgtatcaccgaaataatcaaaaccccaaacagctgttaaaagctgatctcttgtgagcacttgctgctgatgcttcagcaggtggacaagcaggtcatattctctcggcgtgagttcaagcatttggcctgctctttgtatgtctcttgttttctcgttgacagtcaaatctgctatgctgagctctgtctccttctcttcttgctcgtttatattcaatctgagttgcgcacgaattcgcgctaataattcttctatgtcaaaaggctttgtaatataatcattcgctccaagatcaagtccgcttaccttatcaggcacactatctcttgctgtaatcaacataataggtgtcgctgtatttgtctttctaactcttctcagcacctcaagaccgcttaattccggcagcatgacgtcaagcagcaccagatcgaagctttcttcttcaagagcctgtagtccatccattcctgtctctttgaccgtcacctcatacccttcatactcaagctctagtgacagcacccttgcaattttcttttcatcttcaactacgagtatcttccctttgttcatctctatctctcctatctaaaaggcaagcttgtctttccattattatatgttgccttttgcatttggaacagacacaatcttcacgtctatttttttatgaaggaaacatttatttttcaacaaaaacattacacatccttttcacatcgcatttattgcttgatctcattgttatgtagtttgcctcttttagtccttttcacccattttcctctaaacaggtgcaagctcactatgcagcatttccctctttttcatatgatatcaagagttttcctcaaaagatgagttctttcgtcaagatgtgagaagaactgcacttttgataatagattgattatttgaaaaattattacaattgaccctttccgatcaaaagtttcttttatacaataacattacgcagcctgaatctactttgaaaacaaaataaggagggctttcttatgaaaggtgaaattcgcttaattccgtatgaagtaaaagccaatgtgatggaagcgaaagagacgccggaaagtattcaggagattaaagcacccgaactttggtcaagtggcttcaaaggaaaaggcataaccattgctgtccttgatacaggttgcgacacggagcatcccgacttaaaagatcagattatcggaggcaaaaactttaccgatgatgacaacggagatgctgaaaatgtgaaagactataacggacatggtacccatgtagcaggaacgattgctgctacagatcaaaatggtggaattttaggggttgcccctgaagcaaagctgctgatcgtgaaagttcttggcggcgaaaatggcagcgggaaatatgaatggatcattaacgggattaactatgccgctgagcagaaggtggatattatttctatgtctctcggtggtccaagcaatgagcccgccttacaggaagccattcaaaacgcggtaaaaagcggagtacttgttgtgtgcgcagcaggaaatgaaggggacggagacgagcgtacggaagagttctcctacccagcagcatacaatgaagtcattgccgtcggctctgtctcccttgcaagagaatcctctgaattctccaacgccaataaagaaatcgacctcgtcgctccaggagaagacattttatccactctccctaaccataaatacggcagactcacaggcacctcaatggccgccccacacgtaagcggtgcactagccattataaaaaatgccgaggaagaagcgttccagcgcaagctgtcagagcctgaggtctatgctcagcttgtcagaagaaccctgccactgaagcagtcgaaagccctcgttgggaatggatttttatatttaactgcacctgatgtgcttttagaaaagacattggaagcagatcttttatctctataacttgaatagaggtcctgagaatagatcgaattttctcaggatttttttaattaaaattattcaaaatttactttgacgaaatgaagtggacgttatataatcgaacacaataaattcatagtttgagagtcggtaattcgaatcacacatcgaattttaattgggaagaccggtgaaaatccggcgcggtcccgccactgtgagtgaggagagcttttcttatgaatccactgtcataaggacgggaaggatgaaaagcttgcagattcaccagccaggataccagccgctctatcacatcaaaccccctacgattgataggagatgtcggaaaaaagcgtcagttctgctcacgccttatttcgcacacacattttgtctttttaaaccagacatttgccctcatcaatcttcaccatgagtgtaagtgtctttttatatttagaggaggaattggaattgacaattgttaaaacaagtaatctaggttttccgcgaattggtttaaacagagaatggaaaaaagcacttgagtcttattggaaaggtcaaacagaccgcgaaaccctcttaagcacacttgatgaacaatttttagctgccattaaaacgcaaattgatcaacaaattgatgttgttccttctggagactttaccttctacgatcacgtgctcgatactgctgttatgttcaattggattccagagcgcttccgcagcttaaaagacccgctagatacatactttgcgatggcaagaggaacaaaagatgctgtctcaagtgaaatgacaaaatggtttaatacaaactatcactacatcgttccagaatacgaaaaaagcaccgaattcaaactcacacataacaaaccgcttgaagcttacgaaaaggtgaaaaaggcgtttggtgttgaaacaaaacctgttgtacttggtctttatacatttgtctcactttctaaaggctatgaaccaaatgaagtaaaagagattcagcagcgtctcatcccactttacactcagcttttaaaagaacttgaagaagccggcgtcaaatgggtacaaattgatgaaccagcacttgtcacagcttcatatgaagacgtgaaagccgtcaaagaaatctatcaaacgatcaaagaagccgtacctgccttaaatattcttcttcaaacatactttgattcagtagatgcgtatgaagagctagtcacatatcctgttgaagccatcggtcttgattttgtccatgatcaagggcgcaatcttgatcaagtgaaaaagcacggcttcccgaaagacaaaattttagcagcaggcatcattgatggaagaaatatttggaaatcagatcttggcgaaagattgtcattcgtttctgaggttattgctgacgctcagccgaaggaagtatggctgcagccatcaagcagtttgctgcatgtacccgttgcaaaacacccaagcgaacagcttgaagaaaaactattaaacggactgtcttatgctactgaaaagctggctgaattaacaacattaaaagaaggcttaacaaaaggcgccgcagcgattgaagccgccatcaatgaagccaaacaagcacttcttactttaaaagaatttgcaaaaggaaccaatgcggatttcacaaaagaacgcaacaatctttcatcgaaagactttaaacgtccagttgcctttgaagagcgccttcgtatccaaaacgaatctcttgaactgccgctcttgccaacaacaaccattggcagcttcccgcagtctgctgaagtgcgaagtgctcgtcaaaaatggcgtaaaaatgaatggacagatgcagaatatgatgaatttattaaggaagaaacacaaagatggattgatattcaggaggaaatcggtctggacgttctcgtacatggagaatttgaacgtacagacatggttgaatactttggtgaaaaactagccggatttgcctttacgaaatttgcttgggtacaatcctacggatcacgctgcgtgaagccgccaattatttatggagatgttgagtttacagcgccaatgaccgtgaaagagacggtttacgcacaaagcttaacgaagaaaaaggtcaaaggaatgctgacaggtcctgtcacgatcttaaactggtctttcccaagaacagatatctcccgaaaggacattgccttccaaatcgctttcgcattacgtaaagaggtggaagcgttggaagaagcaggaattcaagtcattcaagtggatgaacctgcactaagagaaggtcttccgctcaaagaaagtgattgggcagactatttaaactgggcagcagagtcattccgtctatcaacatcatctgttcaaaatgaaacgcaaattcatacacatatgtgctacagtaacttcgaggatattgtcgatacaatcgaagaccttgatgccgatgtgatcacaattgaacattcacgcagtcatggcggattcctcgattatttagagaaacatccgtatttgaaaggtctcggacttggtgtatatgacatccatagcccgcgcgttccatctgtcgaagaaatgagtcaaatcattgatgatgcattgaacgtatgcccaacagatcgcttctgggtgaatcctgactgcggactaaaaacgagacaagagcctgaaaccattgctgctttgaaaaacatggtgacggcggctgaagtcgctcgtaaaaagctgacgcagcatgcataactgatttcctctcccctgctatcatggcgggggattttttatgcgtaaattgtcctgattgaccatctactagaaggtttccttttctagcatgattcgtttatactagagaagtcagacgaacaaagggaggaagacaatgaatcacgaagattttttacaacgcgcaattgaccttgcagtagaaggagtcaatagtggtactggcggtccttttggagcagtcattgtcaaggatggacagattattgccgagggaagcaacaatgtgacaacaacgaatgatccaaccgcacatgctgaggtcacagccattcgaaaggcgtgccaaacgctgaatacataccaattagaagattgtattttatatacaagctgtgagccttgtccgatgtgccttggcgctatttactgggctagaccaaaagcggtctattttgctgctggacatcaggatgcggcagtttctggttttgatgactcatttatttatgaagaaatcaataaagattacgaatcaagaaatattccattttatcagctgacacttcaaaaaacccttgcaccatttgaagcatgggcaacatacgaacaaaagaaagaatattaaaaaaagacacctgctcatgagcaggtgtttctttttttcagcgtgatagagaacctttttattcagccacttcaagctctacttcgatgttccctcttgttgcttttgaatatggacagaattcatgcgcagcctcgactagctctttcgctttgtcatggtcaaggccttttgcagatacaatcagcttgacaccaagcttaaatccgccatcactttcatcttttaaaagactgacatgtccctcgacttctgattcaatgtcgaccccttgctttttcgctacttgttcaagtgcccctccgaaacaagctgcatagcccgctgcaaataattgctctggattcgtaccagtttctccgtctttctttgcattaggcatgacaatgttatgatccagcacaccatcttctgagcgaacgtgtccagctcttccgtgttgtgcctttacttttgctgtgaataatggtttcatctttatctcctcctttatctatttattcctttcacgttctatccatttctcaaacatttatcgcacattaaataatttttcgtttttgggctgtatttattttaaaaaagaagaaaatcttatacaataataagtatgacaaaaaatagttggtgactgacatgacaaatgaattcgagcacatgaagctggaaaatcagctttgtttcttgttatatgcaagttcaagagagatgacgaagcagtataaaccgttattagaagagttagacattacgtacccgcaatatttggcactgcttttattgtgggagcatgggacattaaatgtgaaaacgatgggagagcttttatatttagactccggtacactcacacctatgctgaaacggatggagcaaaacggactcatcatccgcgagcgctcgaaagaggatgaacgttctgtgcaaattcgtttaacggaatatggagggcagctaaaagagaaggctactgcaattccatttcagatgctgtctgggacaggcagatcggaagaagagttaaaaacgctacgtgcctctttacatgagcttttgcaaaaattaacacaatcaaaaggctgagggattattccctcagccttttatgatatcaattattgtgcgacagctactaattccacttcgatatttccttgagttgcttttgaatatgggcatacgccgtgtgctttatgaacaagctcatctaatgctgattgctcgattccagttccttttacttctaacttaacgcctagtttgaagccgccatctgaactgtcttttactaaactcacatgtgctgttacttcgctttcaaaacggatacgctcttgtcttgcgaccatttgaagggctgaatcaaaacatgcagagtagcctgctgcaaataattgctctggatttgttgctttttctatttttttcgctcttggtgttccaggcattgctacatcatgctcaagcactccatcacttgaaacaacctttccttctcttcctccgacagctgataccgttgcagtaaataaaacttctgacatgtatataaccctctttctctccaataatattttctacaattgaattgtacacaatttaaatttaagagtcaacgaatacacactctttttttaagatttccttcttgcctctcttttatgtagacagtaaaaaaagccctttaataagggcttttagatgatgtcatgctgcgcatgtggttgttgtagcgtatggtttctgttatccgggtcggcatttgctgctgccagccataacgccaagatggtgatgcttgtacagacgactgcccattttttaaaattcatataaacaatcccctctctgaatatagattcgagcatgttctgcttctccgtagaacgtggaagatttttcataatcttccatttcattataatactttgcggtgtctaatgccagctcctctatatctggatatgcataggcagactctaaaaaatgaaaaattcgtttaatatgctccgcatcttgctttaaatacaatgcttctaaaaatatcgtcttttgaatatgaatgtcatcctgaagtgcttctgctcgcttcatacattcttctctgtagtgtaaggcttcttcgtgtttaccttgtttgtataatatctgagcggctgtataaagagggtctatggatcgacgaaggtgatcagattgattttggtcaaataacgagatggattctttcattagttcgagtgcgcggtcaagatctcccattcggtaataactgttgcccatattaaacaaagaggaagcaataaaacgcacattttgaaagtctcttgatctcgcaagtgctctctcgagatgtggtaatgccttttcatgtcttctcatatcatcataattacctgccacaataaattcgcattggatcgtgcgaagcgcatatagctcatgctgaatataaacatccagcgccagtttggcatgatgcatcgagatatgtgtttgtttcatgtgataatatatttctgacattttaaaatgaaattccgcacgttcaatatcatctgacacaaaagaaagcttgtgctctgccttttgataagacgagatggcagcaatatactgcctacggccaaattcatacatgcctctgaaaaaatgatagtagtattcaagcatgcctgtgacatgtgtttgatgctcatctatttctttcgaaagctcggaaaagttggcgcgaagctttccttcctttaatggctttaaataatcgagcatgacctcatgtctgaattccattaaagaaaaatagagaagcaaattctgatcttcttccattgaatcaagagaggtgcgaatttcctgctttagttgttctgcttgttctgaatcaaatctgcggattaattcataccacttgttgattttcactccaatatccgaagagggaatgattttcgccatacgttgccttctccaatcttttcaaaatataaaacattaccatattttatcatacttgaccgaagaaatacaaaaatgaaaggaaaaagagagcctattgtcacaagactctcttttgaattcgttattctcttatttgtccttgaccgcgaatgacaaacttttcagaggttaaggcaggcagacccataggtcctcttgcatgcaatttttgtgtgctaatccctatttctgctccgtagccaaattcaaagccatctgtgaaccgagtagaggcattatgatagacagcggcagcgtcgacagctgttaagaaaagtgacgcatttcgatcattttccgtaatgatcgcttcagagtgcttggaactatacgtttgtatatgctgaatcgcttcttctatgttggctacggttttaatactgacaatcggcgctaaaaactctgtttcatagtcctctgtgctcgctaatgaagcacttggcgcaagggcacatacagcttcatcgccccgtatttctaccccatttgcatgaagggcttcaaataacgaagcgccatatgtttttgcccatgtttcatgaatgacaatgctctcgatcgcgttgcaaacagatggcctttgggttttagcattcagcacaatctgctcagccatttcgtttttcgctgtttcatcaatgtagatatgacagttccctgcccctgtctcaagcactggcacggtagactctctcacgacaagatcaattaaatttttcccgccgcgcggaataagaacatccaaatattcatttaaagtgaacagcgttttcgccgtttcacggcctgtatcttcaatcaattgcacactgtctactggaatttccgttgtgtgaagcgcttcatggatcaccttcacaatcgctttattactatgaatggcagaggagctcccgcgaagaataacagcattcccagttttcaaacaaagggtggcagcatctacagtcacgtttggtcttgcttcataaatcattccaaccgttccaagaggtacacgcaccttttcaatgaacaaaccgttttcttttcgaatagtttctaatgtttcaccaattgggtcttttaggtgaatgagttgaagggtcgcgtctgcgatggcttctattctctcttctgtgagtgtaatccggtcaataacagaaggcgtgaactgcttttccccggcagcctgcacatcttttttattctcatcgagtaaataagcggaagatgctttaagtgccgttgcgatggcatgtaaagctgcatttttttgttccgtcgtttttaggagcagctgatctttggctacacttgctttttttgctttttcaagaacttcattcatcgtattccctcctcagttttgtacatgctgtacccagtgatctctgtgtatgacttcaggcttctcatttgaaagctcatcacttcgcagtcctttaataccgagaagctcatcagatgcgtacaaggtttgtcctttacctactagcccattcggaccgacgacttcaacgacctctcctttagaaaagtcaccagcgacatcaataactccagctggaagaagacttctcccatgatgcaaaatcgccgcttctgctcctgcatctatcatgattttcccagaaacgggtgaatggaattgaatccactgacggcggttgttgatcgctgataagtcctgttctccgatatacgttccgtctccttgacccgcaagaatatgaaacagcttatcttcaccagtacctgtaccaatgaagactttcacgcctagtgaaagtgccgtttgtgcagcagacagctttgatttcatcccgcctgttcccacttttgagcctgtactcttcgcatatgaaaacaattcttctgaaatgtgtgttagtacatcaaaacgcttcgcatcaggatgctcatttggatttgcattataaattccgttaatgtctgttaagatgatcaattggtctgcatgaattaaaccgctgacaagagctgacagcatgtcattatccccaaaagtaagctcctcaatggagacagaatcattttcattaatgatcggtaaaatttttctttccagcagctccatcatcgttgcgtaagcatttcgatatcttgttcgatctgaaaagtcattacgggttaaaagcatttgtgcaggtgtcatgtgaaactgtgaaaatagttctgtatatttctgcattaacaagccttgaccaacggcggctgctgcctgttttccctttaaggtcacaggtcttgatggataccctaagctgccaaaccctgctgccacggctcctgatgaaattaaaataatttcatgcccagcctctttcagctttgctatcgctttcacatgatcctgcattttttgttcatcaatggttcctttttgctctgttaatgaactgctgccaattttgatgacgatcctttgctttttcattattgattccctccgctatacctttaggcacaaaaaaatccctttttctccttatgtaaaggacgaaaagggattttccgtggtaccaccttcattgaataagcatacttctagcttattccactcaactcctgtaacgccaggcacgcgcttagatttttcctctaaggctcaaagggcaggttcagcagctgtctgcggcaaatgtttcagcatgtcatttgctctctttacgcatcagttcctgcttactattccttttcaacgctcgttaatttttttatattatcaccaattgcaaaggaaaagtcaagcggtcaattaaatacaatcgttttattctcatgcacaataattcgatcttctagatgccatttgacggcacgtgcaagcacactccgctcaattgttcgaccaatattttttagagcttccgcatcatcccggtgatctacacgctctatatcctgttcaatgatcggtccttcgtctaaatcattggttacataatgagaagttgcgccaattaatttgacacctcgctcatatgcacgcttatatggattcgcaccgataaacgctggcaggaaggaatgatgaatattaatgattttgttcgggtgctgttctataaaagcaggtgttaaaatttgcatgtatctagcaagcacaatggcatcaatatcatactcttctaataatgcaagctgctgtttttccgcttctttgcgaatgtctttgttcgccttcacaaaatggaacgggattccaagcgcttctactgtatcttttgccgtttcatgattgctgatcacgaccgcaatttcagccatcaaattgccgctttgccattcccatagcagctcatgtaaacaatgaagctcttttgacacaaagattgccagctttttaagctcacttgcacgcgacatgctccacgtcatttgaaaagatgctgcaattggctcaaactgctgcttcagctgatccatatttgccgagatatctttccaatcaaattcaattcttaaaaagaaccggccgctttcatggtctgttgtgtattggctggattcaatgatatttgctccgttctcaaataaaaaggaagaaacagctgatacaattccaggctgatccgggcagctgacaagcaatcttcctttttgctcatgcttttgtctgtgtaattcaagtttctctgttatcaaagttctcatgtatcatgacctcatttacgttttcattctaatgaaatattatactggactggaaagagaaaaagcaatgtagagccccattttttattgaatattcattcaattctgcccctagcgtgatataatgtgaatagaccttttagcataaaaggagtgatggagatgaaaagtatgactttgtttggtaaagtgagcttttggatcggcatcgtttgtctgatcacaggtatttccctttttatagccggcgaaagactcgttccttttctcacatttggtgtgtgttttctacttgtgagccagctttaccgcaaaaatgaaaacgattccaatcatcattcgatgtaacaaaaggctggcatctatctgccagccttttcttattcaatcattttcaatcctactgccgcagataaaatcaatgcgatgaagaaaatacgttttgcatctttcgactctccgtaaaagagcataccgaccatggcgcctccagcagctccgattccagtccaaatggcgtacgccgttcccatcggaatcgtgttcatcgcaagagacagcatcagaaaggacatcgaaaagccagccgcaatgaataaaatccatttgacatgcttgtctttttggaattggttcatcatggtcacacaaagcatttctaagatgcctgctccaataagtaaaagccagctcatgattcagcctctcccttcttttcacctgttgtcagcttcagtcctaatacaccgcacaaaagcatgacaatcaaaagcagtttgacaagctgaaccggctcaccaagcaccatgcctatgacgacggtacctgctgtaccaagcccagtaaaaacagcataaagtgtgccaactggcagtacatttgttgctttcatgagtaaataaaagctcacgataatacaaacgatggttgcgccccattctatgagcgagtgggcatatttcagccccatcacccagccgacttcaaagatggccgcgataaagacatttccccatttcatctgatcttctcctttctgaacgattccaaccaacaaaaaaagcctggaaatcgatcgtttgatcaaatctcccgggcttttatccctccgtgtccatatggcctcttctaaagaccctatgtgttttctctcggaccagactgcaccagcgcacggaaccctagaaaaccaattcatgataaacagatctgacttagagcagattctgtattaaaaatcttaccacaccccaatatgccggtctaccagtttgctctccctcttcaaatatacttgttcatttttcgaaagaaatgatttcggaccggcgtatactaagtgttagaaacagatcaactgataaagaagatctgcgggatatttccgtgctgccaaccgaagggaaatgagcgtatatgacaatccatttattttttattactttgacgatcaagcgtaaatacaaggacatggagaccgttctttacgaacaagaagtcgaaacaatttatgaagaaatgaaacagaaacaactaaagtatatgaactaaaacagaaaaaatggaagaaggaccaagttagaaacgcccagacattaaaggaacggtcatatcgctggtataatgaactcagattgatgagatgaacgttccactttaggatgctgcatttacagattatccgttgtatcggcctaaacaatgctgaaaaacattttatagaaaaccaagaggtggatcatatgatgataaccaacgaacagaaacatgaattttatcaagcactggttgacaagaatccgcaatatgacggcacgtttttcgccggcatcaagaccaccggtatcttctgccatgccacatgtaccgctagaaaaccaaaatatgagaactgtgagtttttctttacagcagaggaagcactgctagcaggatatcgtccgtgcaagcgctgcactccattaacatatccgaacagcattccagaagaagtcaaaacactcgtttcagcagttgaaacacatcctgaaaaacgctggaaagaagaggactttcgcgagctaggaattcactctgcaacggctaggcggaaattcaaagaaatctacggcatgacctttgttcaatatgcgagatcacgccgaatggggcttgcctttaaagaaattatgaatggaaaaaaagtgattgatcagcaggtcgcattgggctatgattcttcaagtgccttcaatgatgcctttacgaaaatcatggggaatccccctaaaaagacgcaaaccaaaattcttcacgctaattttatttctacaccgattggacgaatgatcagcgtgacagatgcgacgcatgtgtatttactggaatttatggacaggcggggactagaaaaggaaattgagaacatgagaaaaaagcatcatgcgcgtattttagttggggaaacaaacgtccaccagcaattaacaaaggaattgaccttatatttcgagaaaaaactgacgcagtttacagtaccactttccatgcatggcaccccttttcaaatgaaggtgtgggatctgctcacacgtattccttcaggcgaaactagttcttaccgagatcttgctgtgatgctgggcgatccgcatttggtccgggcggtagggaatgcaaatggtgccaatcagttggcgatcatcattccatgccaccgcgtcattcaaacaagtggtgagctcggcggctacggcggcgggatagaacgtaagaaatatttacttcaactagaacagcggatataaaaaaacggctctgcttattttgtaagcgagccgttttcttcgttgcgggtgatgctgtaaacatcaatgatttggtcccattttgaaatggttttttcttttttcatgcccatttttaaagcgacctttaccgatgcttcattgtccgggcggattaagcttaccattcgtctgactttcatttcttcaaagccataggtgaggcagccttttgcggcttcagcagcatagccattcccccacgctgctttcttaagcatatagccgatttcaagttctgtttgtccttcaatgttttgcagaacaattccgctttgtccaagtggttcattcgtttctttgtcttcaatgatccagagagaagtatgatagatgcggtcattcttttgattccatgcaatccactctttcgtctgctgctcatccttcaaagatggataatacttcattacttcttcatcttggaacaacatgtcatataaaaacgaggcatcatgttcattcatcgttctcagtctaaggcgctctgtttcaagcactgtgcgtgtttgaagtttcatttatgaacctcccacttactgattaaaaagatcaccgaacagtccatttgaatctggggcaaagtaatggattcccgcaccggttaaactagctgccagcgccgtccacatcattaaactgactgtcatccacaccgcaacttgctttctcttcgtcccgaaactcatgcacataaacgccgctaaatgactgccaatgataaaaggaccgactatcgctaatcccgggagaccataacgttcccaaatttttctcgcccgctgctgctttttttctcctttttcattgcttttgtcctcttttctctttaaccgccatgctttaaagcggtctacgaaaacaatgagcaggaaaacggtaaaaaaattgccgatgaacccaataaccgctgccggtacaggatgcatgccacttaaaatggccagcggaacgacccctaccacctcaaaaaaaggcaaagcagccaatacaaaaacaagtacatatccccataaaatatccaaacacagaaccccttttcatttttgtcctcttcccattgtaatgaaaaacacgttaccatttctacatttttttagaaaaagaaaagcacatcggatgggatgtgccctgtttttttacatcgtattttcatttttcttattcgttcggcgtaaaacaatgagcacaagcccgactaagatcacaatagatagtagactttgcaagagaagcacgcttggtgatgtccagccaatccattcgaatatgagctgcggtccgaaaaagatgattggaatcagtgaaatgagattcgctttcatgattgcattaaaaacaatgatacataacagcataagcaggatgacgccccatctttgacctgaagtcagtacaagtaatggtttgccgagtttttgatccaatagtttgattgtgaccattgaagtcaactgaaagattcctaagatccagaaataaagaaatgcccggcctcctgtttgaaaggaagacgctctaaacatgacaatgatcatgatgacattggctactaaaacgagcggataaccaatcaatgcataccaagaataggataagctttgactgatcgcatctgataaaatcatataaaagagtgaaccaattaagaaggcactgacaaaaggaatccagtctttatggtttcctgacagctcttttgcaagttcatcagcatagccccgcggatctccgccaaacaaagcctcccctgttttaccgtctttttcagcctcaaccgcatgtgtcgtcagttcatccatcagctcatcaatttcgtcctgattttttccctttgatatgagatagagtttcagctctagtagaacgtgtcttgtttcttttgataccataatctcacttccctttttgtagtaaacagtttacattttttgaaagctcactccagcgagtaataaactctatgagcgctttttctccagcttgtgtgagcgtatagtatttccttttcggtccgcttgctgatgcttttgtgacagtggtcacgagctgttccttttgcatacgcagcaggatcggatagatacttccttcactaatttgatcaaacccgtaatgcgcgagcttcttcgtcatttcatatccataaatctcaccctctgaaataatcgacagcaggcagccttctaaaattccttttagcatttgtgtggatgttgtcatctttgttcctccgattccagtaccttgcatcacaagatagcatcatcttaccacacactatcttgccatgcaagataccatcctagaaaaaaatcaccgcttaaagggtgatttttacgcccaaggcttatctgtcccaagtgcgtcagccaaagctttactatgctttcggcggctctttctttcctctgcccgctgcttcgctgtttgatgcagcatgatttcttcctctgtttccggcatgacttgcgggactcgttttggcttcccattttcatctagcgagacaaatgtcagaaatgaagtcgctgcgagtctgcgctctccagacatcaagttttctttcataactttaacgaacacttccatggaagacgtgccaacccatgtcacataggattccaagcatactgactctttttgtccaattggctctaaaaagtcaacagaatccatagaagccgtgaccgtttcactgcggctgtgccttgctgccgagatggaagcaatgtcatctatataactcattaattttccgccaaacaaggtttggtgattattcgtatcgagagggaataccctgctggtttttacaactttcgattccttgcagtatttgaaattttcttctctcatcatcatagctccttcttgctgttttcgtgaatgcggaacgacttttattaaacactattcttttaggtttgtctaaactttttgctttagtctcttgtgagagattttctttcggaaatgtttcaactatgactagaacgaggaataatagaactatgaacaaacaaggaggccatttgatggattctatgagagcagaacaaatacacaaaatgccgcaatgcatgagtgaatatgacgatttacaagaagtccttttatgcagtcccatctatatggaaatcaaacagatcatcaacgaaacccaaaagcattttgcaagagaaaatatttctcaaatgaaagccattgctcagcataagcaattgatccaaatcctaaaagaccatcaagtacgccccattatgcttcctgcaaatgaccgctttcctgaacaggtctttactcgggatattgggtttacgattggacatacactctttgtttcaagcatggccgctccggttcggcaaggagaagaacaattgttaaaagagtgggcacagggaactggattgaatactgttaccctgacaaacggaacaattgaaggcggcgatgtccttgtggatcaaacacgtgtatttgttggaacgagcaaaagaacaaacacagccgctattcatgagctaaaaaaagaactgccggatcatgacatcattcccattcatcttcctcctcacattttgcatctcgattgtgtgatgaatattctgtctcatgatgagatattgatttatcctgaagcgttcaaaaaagaggatcttcacctgctcaacatgcattatcatctcattggaataagcgaacaagagcaattcacactcggaccaaacgttttatccattggacagaaaaaagtgattagtttgcctatcaatcaagaaacaaatgctgctttaaccgctcacggctacactgtcattgaagtgaatttttcagaaatcattaaatctggcggctcttttagatgctgcacattgccgattcggcgttcatccactaaaaaagccagcgtgtagaacagcttgtctacttgctggctttttatctgcctattttatttctgatcgtataaatgacaggcgacatcatgcccttcttctactgcttgtaatgttggctttttttcagcacacacatccatcgctgcaggacatcttgttcgaaacacacagccgcttggcgggttcactggacttggaatttctccttttaaaatgaaccttttgcgcttgtcctccacgtcaggatctggaatggggatcgcagacagcaatgcttgtgtataggggtgaagcggtgtttgatataacgcatcactgctggtcaattcgacgagatgacctaaatacatgacaccgattcggtcgctaatatatttgaccatcgacaggtcatgtgcaataaagagaaatgtcagtccttcctccttttgcagtttcttcagcagattcacgacctgcgcttgaacagagacatccagtgcagaaattggctcatctgccacaataaatttcggtgctaaggcgagtgctcttgcaataccgattctctgcctctgtccgccgctgaattcatgaggatagcgagtggcaaagtcatagctaagtccaacagcttccagtagttctttcaccctggcaacccttctcttttgactcccataaaggttatgaatctccattggctccagcataatatcttttacagacagccgcggatttaaggaggaatacgggtcttgaaacaccatttgaatttgccgattaaaatcaaaggattccttttgtgaaaggtgatgaaggcttttcccttcatataaggcttccccatttgtcggttcataaagacgcataagcacttttccaagtgtggatttcccgcagccagactcgccaacaagaccaaacgtttcaccttgtttcagctgaaaggagacaccgtctagcgcttttaacgtttttcctttcgatagatgaaaatgttttttgagattgtttacttgtaaaagtggttcaactgccatgacctttgctcctctcgcttggcaaataccgtcttgcacctgcccattctttttcatatgaagtgccagcaagagaaagaagttcaatttctctgccggttttaggcgaatgaagcatcataccgtcacctgcatagatccctacatggcggacagctccctttccgttgtcattggcgaaaaacaataagtcgccttgttctaaatggcttgatgcgaccggtgttccttgcactgcttggtcacttgcgtccctcggcaaaagatatccgcacgctttatacatgctgtaagcaaaccccgaacagtcatagccaaagctgctcatgccgccccataaatacgaaagaccaataaattgttttcccttgtctacaacatctttgccggtcatagaggaagtggaggaaactggctgcacatcttctttattgatttctctcgtccctgctggtgtgacaacacgaaagcaatcactcgtttcttctaaagctgcgagctctgttaaaaaactaatttccatgtccgcttgcccgttttgatagagcgtggcttttttctgacaaacgatatgagatatagctggcgcacttccttctgtcacttgctttagttggttcgcaggtatatagccaggatagccttgtggatgtttccggctggcctgctgcggaataacgactttcatccagccgtctgtctcttctaatccaatgactcgttcaccgagcagtacttgcgactggatcagattttcttcacataaagccagtttttcttcatatgtttgcttgtcaatccactctttgattttgaaggagctctgaagtaccttttgatcgatttctctcggtgactgcggcgctgtccatacattcgcaactggaacctttgattcaaatatcatcatgagactcctttcaccccttgaatgcctaatccatgatgcggcgggaaaaagatatcttttcctttgtacacgattcctccgtctaccatgtcctcttttagcatcagcggggcatcaaaatcatagcggttgatattcggctggcttgcggcgagatgagcggctgctgtaatgccgagttttgactcaatcatactgccaaccatgcactttacgccgtatgcttctgctaaagcgttgatttttaaggcttcttttatgccgcctgatttcattaattttaaattgatcaaatcacagcttctcgtttcaagcaccttgatcgcatcatgaaaactgaaaatgctttcatctgccataatgagtgtatctgttgcctccgtcacacggcgcagaccttcgatatcttcttttggcactggctgctcgactagttcgatattcagcgcctccatttttcgaatggctacgaccgcttccttccacgtccagccctgattcgcatcgagcctgatctgaatatccggtccgaccttttctcgaattcgcttgatacgctgaatatccgtgtctatatcatcttttcctaccttgatctttaatgtctgaaagccttctgctgcgtattgcttcgcatcttccgccatctcaagcggccggttcacactgaccgtataatctgtttcaagctgactgcgatatccgccaaggtattgataaagcggaagtcctgcctgcttcgctaagccatcataaatggccatgtcaaccgctgcctttgcgcttgtgttgcaagcgagcacacggttcaaacgagaaaaaatttgttcatactcggacaaggaagccccaagcaatatcggtctgatcacttcacagatggcatagtcgatgctttccagcgtttcacctgtaatcaccgctgtcgggactgcctctccgtagctgacgtcaccttgatcatatgtgatgataacaatcagagatgctgcgtcatacaccgttcgcaaagcggttttgaacggtttttttagcggtacgctcattctgcatgtacgaacatcgacgattttcatttgatcgcctctttcgctgcaacgccgggagaaatgtacagttttttccctgtcgcatctaatgcagcccgcgtgcccattggaatggcaaagttcggagaagaatggccaatccgaaagcccccaagtgcaggctttttttgcggcacaatataggtgtcccatacttgattcaatgtgagggactgatctttcttttttggttcacattgatgaaaatctccaatgatgaatccagccgcatcatccaattttcccgcagatatgaggtgctgcatcattcgatcaattttatagggctcttcatcaatatcttcaatgaacaaaagctttcccttcgtatcgatttcaaaaggtgtaccaagtgttgtcacgatgagggcaagatttcctccaacaatctcacctgaagcggtgcccggatagaaagtatgaaggggtgacaagtggtgcgcatacgtaaaggttttcggtgcgaacagctgtaaaaaggtatctttcgtataaggatggacctcctcaagtcccacatcagaggagagcattggaccatgaaacgtcacaagacccgtctgctgctggatggccgtatgtaaaaacgtaatatcactatagccccaaaagatttttggattccggcgaatcaggtcatagtcaatggcttccgcaagtctgccagtcccatatcctccgcaagcacaaataaccgctttcacttctggatcttgaaacatgcggtggagatcctccactctttcatgatcatgacctgctaaatacccgtaccggcggcccaaatacttcccttttttcacctttagcccgaggctttctaaaaaggcaatcccttttgctaatttcagctcatcaggcgggcttgctggtgcaataatccccaccgtatcccctgtttgaagtgccactggcagctggctcatgccatatcccctctttctcttcgtttctttcaatctatgggtttctgcttcataacatgaacgaataaaggaacagacgcttttatttcaaagcgtcttctgatcctcatatcactctccatctacttgtgcccatttcaaatcgatgtacccaacagggtgacggacaatccctttcacgccttctttttgtaaatggacttgattataaaaatgaatcgggatgatcggtgcttctttaatgagaagtgcctctgcatcatgaagaatgttgtttctcttttgctcatctgcttcttggcttgcctttttgatcaactgatcataggtatcgttggaccatcctgtccggttcatcgcattccctgtttgaaagctctctaggaaattgatcggatctgcatagtctgctaaaaatgaactttgtgagaattggaatttcagcgccttttgatcttctgcaaatacattggcttccatgtttgcaagcttcacatctacacctagcgcttctttcagctgctgttggatggcttcagcttttttcttgttctcaggctttgtactatatgtcaatgtgacggctggcagttttgaatagttctcttctttcagccctttttctaatagcttcgcagcttcactcttatcattcttcacaagatcaccgccagcttctctgaaatcctcgccctttgaatctagaatgcctggcgagacgaaagcacgtgctggcttctcttcattttttgtcacataatccacgatatcttgcgggttgatcgccatttgaaaagctttgcggatgttcttattttgaaaaggttccatgtttacattcagacgataaaagaacaatccagcctggtcttcaatttgtacatctttatttttcagcagattttcactttgctctgctgggacaaaggcagtatctaaatctcctgattgatacatttgatagtctgtgtttcgatcactgatcatcagccacttcacttgatccagcttaactgatttttcatcccaatacgtctcacttttttccattgtgaagctctcatcatgtttccactctgtcagcttgaacggtccatttccgacaaaggttttggcgtcttttgcccagtttgggtccttctttgcgaccagttcattgacaggaaaaaaggcagggtttgcggtcatatttaagaacgatttctgcggatatgctagtgtgaccttaagcgttttgtcatttacagcactgactttcacgtcttctttctttcctttgccgctgttaaatgcctctccgccttcaatcatgtatgctaggaacgatgcagaagagcctgttttcggatcaagaagccgcttccacgcatattcaaagtcactcgctttcactggatcaccatttgaccacttgatgccatctcttaaatggaacgtatacgtttttccatcctttgaaatctcccatttttccgccattgcaggagatggttcgtgcttttcattcagtcttgttaatccctccattaagttattgagtccttgccacgatacattattaaaaccaatcggcggatcaaacgacgtcggttcgttttcgttatttaaggttaatactttcttttcaccctctttgcttgatgatcctttccctgcttgctcattggctgtacaccctgcgagcagcatgatcgtgaacaagcatatactgatgatccatcccttttttctcatcaaaaactccccctttgtgttgaagataaaacggtttgattcgcacgctcatcttggagccagcaatgcactgtatgggtaggtgaccgctgcgtttcatgcggcatgatatgatcacataccctcatggcggcagggcagcgatctgtatacggacagccctttggcggagcaaataaatcaggcgggcttccttcaattggaatgagttcatctttcatatcaagtcttggaacggattgcagaagtccttttgtataagggtgctgcggactgtaaaaaatatctcgcctcgttccgacctccaccattttccctccgtacatgaccgccactcggtctgcgacttgggctacgacccctaaatcatgtgtgattaaaataatggtgacccctgtttttctctgaatctctttaaacagctctaatatttgtgcctgtatggtcacatccagtgcggtcgtcggttcatcagcaatcagcactttcggctcgcaaatcagtgccatcgcaatcatgagccgctgcctcattcccccgctgaactgatgagggtattgctttagcctttccttcggctgcggaatgccgaccaaatcaagcatccgaatggcggcttctttcacttcttttttcgtcagcttttgatgctcctttgccgcctccatgagctgatcgccgattgtcaaggttgggttcagtgcggtcatgggatcttggaagatcatcgaaatatcgacacctcgtatggcgcgcatttctttttcagataatgacagcaaatttcggtcttcaaaccagatttctccctgatcaacatgagcgctgtatgctggcagcagcctcatgatgctttgtgaagtcacacttttcccgcagcctgattctcctacaatggcaagggtttctttttcatatacatccacattcactccgcgtaccgctcgaactgagccgccatatgtccgaaagctgacgtgcagatcgatgatttgtagaacttttttcaaagcgccatcacctcttcatcttcggatcaagcgcatcttgcaagccatcacctaaattgttaaagcaaaacatcgtgagtgaaataaaaaacgcagggaaaaataaacgccaccaatgcccgttatctgacagcactgtcggcagtgcatcattggccatcacgccccagcttgcaaacggtgcttgaatgcctaaaccaagaaagcttaggaacgcttctgcaaatatcgcggtcggtacagttaaggtcatctgaacgataatcggccccatcgtattcggcagcaggttgcggcgaatgatacgcagactctttgcaccaaaggtttttgaggcaaggacatattcctggcttttcagctgaagaacttgacctctcacgattcttgccatgccaatccatccggtgacagtgagcgctacaataatggtgacaagccctggccccatcagaaccatcaataaaatgacaacaagtaaataaggaagaccgtagagcacctcgacgattcgcatcatgacatggtcatatctcccgcccttataaccggcaatccctccatagatcacgccgatagcaaaatcaatcagggctgccatgacgcctacaaataacgaaatacgtgccccgtaccatgtacgcgtgaacacatctcgtccaagctcatccgttccgaaccagtgagcagcggatggcggcagattttgcatcgaaagacgctgctctgtcacgctattaggtgcaagcaatgggcctaatagtgccatgataaaaagaaaaatcaataccgatagactaaacatcgcaagcttattttgcttcagtcgtctccatgtgtctgcccaatacgaaagagagggtcttttaatggcatgggcctccgttttcttttgctctctcggagaaaaccattcgtccggcacttcatgatgcggattcggttgatcctgctgcaagtgtatactcatgcctttcctcctttctgatgcagctgaatcctcggatcaagcaggcgatacgccacatcaacaatgaaaagaagtgtgattaaaataatgctgtaaaaaacagtggttcccatgatgacaggataatcacggttgttaatactctcgacaaagtattttcccatgccaggaatcgcaaatattttttcaatgacaaaacttcctgttaaaatacttgcgacaagtgtgccaagaatggtcacaacaggcaaaagcgcatttcgaagcgcatgtttgaacacaattttaaagggagaaagtccttttgctttagcagtgcgaatatagtcctgagacagcacttcaatcatgctcgatcttgttaaccgggcaataatggccatcggactaacggcaagagcaatggttggcagcaccatatgcatcggacttgtccacatcgctgtaggaaagagcttcaaattcacagcaagctgctgaattaataaagtagcaaagatgaagtttggaatggatataccgaaaacagcaatggtcatggcgatataatcaatcaagccattgtgccggagggcagccatgaccccaagcaggatgccggagatgacagcaatcaatattgagataagaccaagttctaatgagactgggaagcctctcgccaatagatcattgacactttcagaaggctttttaatggaaggaccaaaatcaaaggtaacgatggattttaaatagatgacatattgaacatacagtggttcgtctaagtgatagtagctttcgaggtttcgctggacagtttcgtttgtatttcgttcttcattgaaaggcgatcctgggatgaccttcattaaaataaacgttaacgtcgtaattgttaagatcgtggcaatcatcgcaataaaacgcttgagcaaaaagctggtcatctgccgtctccccctcgtttaacaaaatgttgtacgtgcggcaagctctgtcatgacaagcatcgcttggtaggcttctaatatattctctgcttgatacgtcaccgttgttgttccttctatgatggcagtacctggcattaaattcgcccattcagcttgtccataattggcaaattcaatcttcagcagcggctgatcaggaggcgtcagcggcttgatgtaatgaatctgtttcattgcagcttccacttgctgcgagatttgttggttgactttggcaggagtgagacatttcacagcagatcttgatatggtctcttttactgccactgttttcacaccaggcatcagcttttctgcttcaagtgctgcttgatcatctccgcaaacaagaatcaccggcacaccgtagtagcctgcaacatacgcattaaagcccatttcaccaattggatgatcatttatgtaaaaatgtctgacaccaaaaatcatactgtgggacatcacacctttcatagacgccctcgcatgatagcctaaaaaaacagcagcgtcataggattgatctaacccttgaaccattgaataaggcttgacgtcaccagatataagagatgcctcttcatgcaattcttcaatcaacaaattattcattttggaatgactgtcattgaccaagatgtcggttgcgccatgctgaagaagagcctccacacaggcattcacttcacctgtcatgatctttctgccccgttcataattgtgctgacgggcatcaacaaatgtatgatcagctagaccagtaatcccctccatatcgacagatacatagagcttcatccccatccccctttaattaaacttaaaatttgtgtatatttttctaaattttctaaaaaattatatgattacttgattgatttttcaatacaatgtctgaaaataaggaaattagactcagataatacaggtcaaaagactttgtgacaaaggatttttttaacaaataaaacaccactaactatgtctttagtggtgtttgtccgcttcgttaatctgtgattttagctgttcatatttcttcatggtttgtgtaaatagatcatcaaacatctgaggtgcctgcttttgaataacatcggcgccttctcctgtaatgcccccttttgtcgccaccctatcgacggtttcagcaaaggtgaggcctcgttctacaaggacttgacctgtgcctaaaagggcatacgttaaaaattcatacgcttcctctaaggaaagctcactgtttctcacagcagctctcgccatttcttcaaaaagagcagcgataaaaccaggagatgagctcgtcaagttactcgccgcatcaaactggtcttcccctatttcacgtacgatactaaaagctgaaaggagacgatgcaaacgcaccttttcttcctctccagcagtttcaccatgcgcaacgagggatacgcccgttccaacagctgacgtgagcgttgggatgtatctggaaattgggtgagtcgtatgctttgataacttgtctaacgtcacagccgcggctactgacacaatatgaaccgatttggctgctgaaggcagttgatcgagtacatcaagtacagcaagcggcggcacgcagataaaaagtacatcacatgacgcagaaagttcgtctaatgagcagatgtttatttcttgatgcttgtctttgagttgaagcaggcggtccgtttcacttcttgtatggatcatgatttgatgggcattgagcacttctttttccagccatttttgcaccatcatatcagccatgcttccatatccaatgattccaattttctccacagtttaatctcctctatttggcttagattcactacttattttaacaatttcccacaatgttttcatttttatcccacacttttttcttacgataaagccaatcgccacacataaggtcatcccacctcgaaccatacatgaaaaattgaagaaagagagtgattcgaatgacacatcacaaacatgaaaaccaaccttctcatgagattcaaacaatgaagcagccacaaaaacaaaagaagaagccaaacagctggtttaagccatttgttagcggcattgtaggcggcatactagcgttaggtgtgtatgtccttacggcatttgcccagcacgcatcaaacaacacagcaagcgattctgctgcaaaaacagaagctgtatcaacaaatgatacaagtgccagttcgtcaaaaacaactgctgtccaaacatcacattcatcaagcagtatctcaagcatggtcgaagatgtatcgccagccattgtcggcattacaaactatcaagcgcaaagtcaaacagacatgggctttggcgatttcaatacgccttttgatgaatcacagcaaaataaaagcagtcaagaggaaaaaaccggtacaggctcaggggtgattttcaaaaaatccggcagcaaagcctatatcttaacaaacaaccacgtcattgaaggggcaaataaactcacagtatccttgcacgatggcaaaaccaccaaaggtaaattggtcggagctgacccgctgactgacctagcagttgtagaaattagcagcagtcatgtaacgaaggtcgcgtcattaggcgattcctcctcgctgcgtgctggggaaactgtcatcgcgatcggaaacccgcttggtgaagatctatcaagaaccgtgacccaaggaattgtcagcggtgtcgaccgaacagtctcaatgaacacatcagcaggcgaaagcagcattaatgtaattcaaacagatgcagctattaacccaggaaacagcggcggaccacttcttacgacagatggaaaggttgtggggatcacgagtatgaaaatttctgaaacaggtgttgaaggtattggattcgcgcttccaatcaatgatgtcaaaccaatcgccgatcagcttctcgcaaaaagaaagattgagcgtccatacatcggcatcagcatgctggatctcgaacaagtcccagacatatatcagaaagaaacactcggtctcaaaaacagtcagcttgatcagggcgtatacatcaaagaaatcgccgcaggctcacctgccgccaaagccggcttaaagtctgaggatgtcattaccgccatcaatgggaaacaaatcaaaaccggaagtgaattacgtcatgaactatacacaaatacgaaagttggagacaccgtaaacatcacactcattcgaaacggaaaagaagaaacgaagaaggtgacattaacacaaactgaatctaagcaggtaagttcctaatgcaaaagaaaaagggctaaaatcaagatgattttacccttttttcttttcagcgcgatagaaaacatttgcagacctgacaaaaaacgcaagggtttgtctatacgctgagcagctcatgaatgaactgctttttatgatgactgaattggcgttaatctctgctcaatttctgctcgtttgtgctctagaaatggaggaagagctaattgatcgccaagctcatctactccttcgtccactgtaaacccaggaccatctgttgagatttcaaataagataccattcggttctctaaagtaaagggctttaaagtagaaacgttccacaacaccagagttcgtgaagcctgcttttgatattttgtcataccatttttccagttcctcagcatcttccacgcgaaaggctacgtgatgcacacttcctctgcctgaacgctcagaaggtccttccgttttttcgatcacatgaatttctgttccagcaccgccatttcctgactcaaaaatggtcacgatctcaccatcatttgattgttcacgcgctctttcggtaaagccaaggatgtctgttaaaacacggatcgttttgtccgcttctgcaacagttaattccactggccccaaacctctaatggcgaactctgccggaatatcatcatgcactggcggtgagcctgcttcttgtgcgttcggttctactgttaaaaatagctgctgcccttctggatcttgaaagcgcaaggcaggtctaccccctcttaaggaagccgtttcttgctgcacgcctgtctcttcaaaacgcttttcccaaaatgaaagtgcttcttcagaagaaacgagaaggcctgtgcttgtgatggcatttgttcctttcaaacgacgggcgagcattggaatttcaaagaaggtgagctccgttcccggtgaagcgacctcatctccataaaataagtgatacatagaagggtcatcctgattgaccgttttctttacaagttttaagccaagaatctggcggtagaaatcaacattcttttgagcattggctgttaatgcagatacgtggtgaatcccattgattttcattatattcactcctatttcaaaatatctcgaattcaagataatatccttatgaataaaataggtcatttttcaagaaaagtcaaccatttggctagatgttcggtttctaacgataaaattaacattaaatcaaaaataatcttttatcgttcgtttttaacgaaacatttaccctgatttctccaataaacgaacacttttaaatacaaatacgaaaatcagaaaatttttttaattcttgttttcctaaaatcgtattacaatgaacaaaatacatgtcacagtaacgtacgaaagtgatgcaggaggtcgtgtgtaatgaacaaagaacaaccagcgttaaaacaggacatcggcttatttttcgccctatctcttgtcatcgggacgattatcgggtccggcgtctttatgaagccaggcaacgtcctttcctattcaggaagctcagatatcgcattattcgcttggctgctaggtggcattttaacccttgcaggcggactcactgttgctgaaattggcacacaaatccctcggactggcggattgtatgcctatcttgaagaagtgtatggtgagttttggggctatttatgcggctgggtgcagattatcatttatgggcctgccatcatcggtgcacttggtctttattttggttcattgttagccaatttattttctctttcttctttatggtcgacaacaatcggcattatcactgttttatttttatgtttaattaacattatgggaacaaaatacggcggttttgtacaaggactgaccaccatcggaaagcttgtcccgattgccgctattattgtgtttggcttatggaaaggaaacgaaaatattttgatggcagtcaacgatagtatcgctcaaatgaactttggtgcagcgattttggctacgttgtttgcttatgatggctggatattgcttgcagcacttggcggtgaaatgaaaaacccagagaagctactgcctcgcgcaatggcaggcgggattttaatcgtcacggcttgttatctctttattaatgttgctcttttgcacgtgttaccagcagatcaaatcgtacagcttggagaaaatgcgacaagtactgctgcgacaatgctctttggaccaatcggcggtaaggtgattagtatcggcatcatcattagtatctttggctgtttgaacggaaaggttctttcattcccacgtgtgattttcgcgatggcagagcgaaagcaaattcctttcgcaaacgcgatttcgcgtattcaccctacatttaaaacaccgtggattgctgtatttgtacaaattttgatcgccattgtatttatgatcgtcagcaatccagaaaaactgtcagaggtttcgattttcatgatctacatcttttatgtcatggcctttttcgcagtctttaaactgagaaaacaaaacaaaggaatggagcgtgcttatagcgtaccactttacccgctcactccaatcgttgcaattatcggttctttattcgttttaatcagcaccatgatcaccgactggaaaagctgtctcatctccatgctgatcggaattgctggactgcctatttattattatatgaaaaaagcacataaaaaagcagagcgctaatcagctctgcttttttctttcttcacagcgtgatagaaaacctttgctttctagaaagaacgagcatccaagcgcagacctgtcaaagaatgcgaggttttgtctaaacgctagtgctctgctattttttatattgcttaatcactttgtatgattcgtttaaatatctcatgagccggtatggcttactaagcacgcggattgggagtcttgagataaatccattcaaattcgccttatattcctgcgtcatccgttttggctttgtcgcaattttttcgtatacttctttgtaaaattccttcatgatgtcgacttgcacactgatcttctgatgacactctgtacactcaacgcttttcatctgatcattcacataaacgatgctgtggagggtctcttcttggcaccgagtacaatgtaggttcgcttccatttcggttttcttcaagatacacagctcctttctcgtttgatgttgctctttttatacaattcgatggctatgagccgtttattggtcggaagcttcctttaaaatggctgccgccgttagttcgtctgtcaccagcacttgaatgaatccgccatttaaagcccctaaaatactttcagctttatgggttccttctacaacagcgatgaccgttttgacgctctttaactgctccagtgataaaccaatgaccttttgattcaattcatcttggacaggtttgccttgaccgtcaaagaaacgaaagccaatatcacctacagcccctgattgccttaaaccagataaatcctcttcttttaagtaaccaactgtttttaacgttgaacctttatgcgggttgccaataccgatgagggcaatgtcgacatttttaccttcttcaagcacagcttctatatcctgcattgccataagccgctcttttaattcttctgtttctaaaatcgccggggcatataaataggaacacgtgccattcattttctttgccagctcatatgccagctgattggcatgaatgtcgactgcctgcctgcccattccaccctctaatggaatgaccttcacatcgtttcttcgctcgaacgggtattcctttacaagctcagctagcgtagttccccatgaaatgccgattttctccgcatctttcatgtttttagataaataataggcgccagcttgaccgacggcacgtttcaccatctcagacattgtcccgacacttgggacaacaacagcatctgttaattgaaaagttgtttctagctgcttttccagttccaccgtgtgaatactttcgtctttaatgtacacctcaacgattcccacatcttttgctttttgtaagagctttgaaatgactggtctcgagacattgagcttttttgcgatttcctgctgcgtccacccgtctgtataataaagatgagcaactttgacgagctgtcgtctttcttcccaattcagcatgtgacatcatccttttaatatactatgattcccagtataccaaacattcgtttctaattggaacaattgttacgaaaatgacaaaaagagcgattacctctccgctctttttccctccgtatattttggctgatacgttctcccgccgtctaacaggataatttgtccgtgcaaatagcttccctcgtcacttgtaagaaataaagtgagtcctgcaatatcgtctggtcttcctaatcttccgacaggaatgagcgattgcagctgccttttctccacctcagtaggatagagcgtatcaagcatttgagattcaattacgcggggggcaatcacattgatacgcacatggtgcgcccctaattcctttacgagcgaacgcatcagaccaaaagcacctgcttttgaggcgtaatactgaatcccgccgcctgagccagttatagcagatcctgatccaatcatgacaatgcttccttcttgccactcacatatataaggtgctgacgctttgatgcaataataaagaccatacaagttcacagccagtgtctttttccaaagtgaaaaatcgacttctaaaaaaggaagtgattttgtcatccctgctgaatacacaagatgagcaatgccgcctagctccctttcagctgctgagatcatctgctggacactttcccacgatgaaacgtcagcttgaaatgtcagcagctcagaatgctgtttttttaaaagtgaaagtccttgttcatctatatcagacacagccactctgtgtccttcttttaaaaaacgctcggcaatttcctttcctatcccttgggcaccgccaacgatgagaactggtttttgatcattagccagcactctcacccccatcaagcataatcgctgcaccatctgtaaatgcgccatatgatgtacttaaaaagaccgtcatatgggccacagtctccttgatttgctctgtgttaggaatcaaatggagaggcggcggtaataaggcgagcacccgaatgcctttgtctttaaattctcgcgccagcccttttgtcatggcattcagcatagaattcgatgtcgcatgtgaaatcccgccatcacctgtgatactgcctgatgacgatatattaataatacagcctttcttctggtcaaccatgtgccatacggcagcttgactggaaagaaagacagtattcacagctgtttccacttcgtccatccattcattagggtgagtggcatcaagctccgcttccgttccttgcgctgcttgattgaccaaaatatccagtttcccgcacgtatcgatcacttgcctcagcatacgcgtggcatcacgcggcgtctccagcgggttcatgatgatactcgcctgaccacccattttttgaatgtcttcacaaatggttctagcctttgattcatcatgaaatgtgtgtaaaaaaacatgtgcacctgcccgggctaaagccaggcagatggcttctccaaacccatctgtgctacctgtcacaagtgccgctttctgatgaagctggacgtgcacatgcatctcctccctatcccttgtttagcatttattttctcagcttactcacgatctcaagagctgcttcataaaaaccttctgagatggtcggatgcggatgaatcattttcgccatctcttctgctgttccttctaaatacataaaggaagaagcttctgaaatcatctctgtgacatgcggaccaaccatcgttgcgccgatcacttcaccatatgctgtatcgtacaccaatttaataaagcctgtttgaacacctgccgctaacgctttaccacttgccgctaaatcaaatcgttctgtttgtacgctgagccctttggcttttgcctctttctccgttaggccgacacttgccacctctggtaatgtataaatacatctaggcataatatctgcattcattttttcaggcacgccgcaaatattgctgaccgcaacagcagcctctgccatcgccgcatgagccagctgataaccgccggcgacatccccaactgcgtatacaccatcagcacttgtctgcatctgatcattcaccttgataaacggaccatcgagctgaagatcaagctggctaacagctgatacattcggttttcttccaacgcagacaagcagtctttccgctgtaaagatgtgtgtctcccctttatcatctgttgcatgaaccgctttgactccttcgctttccgtcaactctgtcacagtggtcttcttcgcaatatggatgccctttttcttgagttctctttctagcagcttagatgcttcttcatcctcttgtgggataatggacggtgccgcttcaataatggtgacttttgattgaagactttggaagatacaagcaagttcaagaccaatgacacctccgccaataatgacgacagaagcaggaatatctgggatgtcaaagattgtatcacttgtatcaaatgaaatatccttaagccccggtattggcggaatggccggtgaagatccagtagcaatgattaactctttcgtttcaatcgattctgatccaccttgattttctatttcaatccgatgcttggtcaccgctgtgcctctgccgttatatacatcaatctttccttgctttaataaaaaggcgattccacctctgagcttttcaatgacgtcatctttgcgctttctcattttatcgaaggaaaggatcatgtcacctgtttcgattccccagcttttcgccttctcgattgattcaatgacttctgcatgtttcagcagggtctttgaagggatacagcctcgatttaaacaagtaccgcctagaaaatcctcctcaatcaaagcaaccttccgtccgcgctcagccgcttgaagggcggcagtatacccgccaggccctccgccaatgactgtcagatcatacgttttcgtcatccgattcatctcctacattagcaattcaaatggttgttcaagcacttttttaaggtctgttaaaaaggcagctgctggtgcgccatctaccactcggtgatcaaacgataaactgacacccatcattggccgcacctgaatttctccatccactgcaacaggcttatcttgaatccgtcctactcctaaaatcgccacttccggctgattaatgatcggggtaaaggtatcaatggcatacatgcctaagttactaatcgtaaaagtggaccctttcagctggtccggaagcagcttttgatcgcgtgcgtttcggccaatttctttcgcttcttttgttagttgttttaatcctttttgattcgcatgagaaatgactggtaccatcaagccgtctttcactgcaacagcaagaccaatgtgtacatcctcatggaaatggagctcattttgttcaaatgtcatattgatctgcgggtggcgcgtgagtacatggctgaccgcatgaatgatgatttctgtgaacgacaaccggtagcctgtctctttttcaatcgccgggagtagctgctgacgcacttcttttgctttcgtcatatcaatttcacttgttaatgtgacgtgcggtgctgtaaaggcactttgtgacatgcgatcagcaatcacttttctcatgccagctaatttttgtgttttcacaggcgaagcctctgttgtttgcgttgctgctgcttgtacgtcactcttcatgatcttgccgtgagcgccagatccagaaactgctgctaaatcgatcccttcacgagcagcgactttttctgcaagtggtgagacgcgtcggtctttctcactagaatgaacgactgcctcgacgtcccgcttttggactctgccttttggtcctgtgccagatacctcttgaatcgccacatgatgatcttttgccatttttctcgctgcggacgtggcacgtactttttcatcagatgtttttggagcttcagtagaactggatgaagacgagtctggtgaagatggttcgctgctttctgaggaatcctcatctgcctgtgctggcggctcgcttggcacctgttcatttgcctctccaatatatccaataacagcattgactggaatttgatcatcagcttcgtagtatttttttagaaaaatgccgtcatcataggcttccacctcgatgttgatcttgtctgtcataatttcaaaaagaggctcaccgatttcaaccgaatctccttcttctttaaaccattgaagcaaggttccgatctccatcgtactgcttagcttcggcataaatatctcttttggcatgatcttctcccctttatttaagagcgtgcaagctcttttgctgcttcaataatatctggcacttgtggaatgaccgctttttccagtgtcgggttgtatggtattggaactgcaaggccgccaagtcgtttaatcggcgcatctaagtagtcaaacgcttcactttccgctatcatacttgcaatctctccgccgtagccgcctcgtttgaccgcctcatgaaccacgatacatttacccgttttcttcacagattcgataatggtttcttcatctaatgggacgagtgttcttgggtcaatgatttcaacatcgattccctctgcttctagttccttcgccgcttctaatgctttgtgtaccataatcgctgttgctacaattgtgacgtccttcccgcttcttttcacatcagctttccctaaaggaatcgaataaggctcttcaggcacttcgccgattgttttatataaaagcttgtgctcgtagaaaatgacagggttgtcatcatccattgctgcttttaaaagtcctttggcatcataagctgttgaaggctgaaccacctttaatcccggaatatgagccatccacgcttctaagctttgtgaatgctgcgctgcggcacctgttcctgatcctgctggtgttctcacaacgagtggtacttttccttttccgccaaacatgtatcgtgttttagctgcttggtttacaagctgatccattgcgattgtaataaagtcagagaattgaagctctaaaatcggacgcatacctgtcaaagccgctccgactgcacctcctgcgatggcagcctcagagattggtgtattgcgcacgcgctctggaccgaactcttcaatcatgccgcgcgtgaccccaaaagcaccgccatatacgccgatatcctcacctaaaatgaatacatcttggttctctctcatttcctgactcatagcctctcgaacggcttctaaatatgaaatctctctcactgttgtttttgtcacgtgattcccctcctaattaggcgtatacatcctctaatagtgtatcgattgacggttctttactgtttttagcgaattctacagacgcttcaatttcttgcttcgcttcttcctgtaaaaccgctgcctgctcttctgtcaaaacatttagttcaatcaagagagatttaaagcgcttgatcccgtctttttgtctccactctgtttcttcttcacgtgtacggtattttttcgcatcactcttagagtgacccttccagcgatacgttttcatttcaacaagtgatggaccttctccagctcttgcacggctgaccgcttcatctactgtgttcataatctcaaccatgtcatttccatcaattgattttcctgggattccatagctttctgctcttgttgaaatgtcttcaatgttaatcatttcttttacagggccagacataccgtactggttgttttcacaaatgaatacaacaggcaaatcccaaatggatgcaagatttagtgcttcgtgaaagcttccttcatttgtcgctccatctccgaagaaacaaagaacgacaaagccttcctgtttcattttagatgtgagcgctgcacctgttgccagcgggataccgccgccaacgattccatttgcgccaaggttccctttttctaaatcagcgatatgcatcgagccgccttttcctttgcaataaccagtctcacgcccgaatagttccgccatcatcttattgacctctgcaccttttgcaatacagtgaccatgtccacggtgcgtactgacgatcttatcttcgtcctttaatacggcaattgatccaacagctgacgcttcctgtccgacacataaatgagtggttccatggataagtcctttcgcaaagaattgatcgaccttttcatcaaaatatctcactaaccacatttgtttatataaatctgctaatctctcatgactaatctgttcaggcaaagtgatttgtttttgcatttattctctcccctttacatttgttcttgtgtgttacatttgtaattatcatacgtttaagtatcattgaagtcaagcatttctctttcatttttaagcgttttcaccttttatcagaaaaaaagagaaaggcaaagcccttttctaaagaacttctctttctctcccaatcccttacgttctcatttatctggatacatcatgattttgacactctcaccttcagggtgccttgcgcattctatcgcctgaaggagctgacttaacggataacgatgcgtcaccatcttttctgtgttgaccacttttgctcttagaagttcaagggcttcgaggtagtgataaggatgcgaggaataggctcctactactttcacttcatcatggaaaaaccgatcagccggaatggagacgtctccctttgggaaatgagcaaatactaaaatcgttccgcctctcgctactgcttgaaacgcttcttttaaaagcgcactactcccaacagaaataatgacgaggtctgctccctttccatttgtttctctcatgacctggtcttccaccggctcagaggctggatgaaaagcgacgtctgcccctaaatttctcgcttgcagcagccggttctcattcacatccgttatcatcactttcccagccaagtaatgtttggcaagctgtagttgaatgcagccaatttgccccgctccaaggatcagtacagaatctcctggatgaacaggtgctcgttcaaaaccgtgcaggcagcaggcgactggctccaccatcgccccttgctcatatgagacgtcatttgggagcttgcccattgtgtgcttgacatgtaatgcaggtacgcggatatactctgaaaacccgcctggctctacattagtggctgcaaactgcggacacattgtataaaatcccctttgacaaaagtcacaggtaaagcaaggcacatggtgcgcaacataaaccctgtctcccgtttttatatttgtcacatgctttccggtttcaacaatatcaccagcgatttcgtgccctagtaccgttcctggaggtaccgtctcatgtgttgctttgtaaatatctgtgccgcataagccgcaggcacgcatccttaatagaacttcatcatcacttatcgcaggccggttccgcttctcataccgaatgtcctctgaagaataaaagacagctgatttcatgtagctgcatcctccttttcatcacctttcgcaaaatcctgcaacgtttgcacaagctgcttgtactcactcatctcactggatatccagtaacgtcctccgaatatacgagatgggcccaccctgacatagacttttccgatatgagggtatggcttaataaaaagctttcctttaatatcagagaccgcatatgtgtgccatctgccaaacgctccgattttgagtttatcttcactaatgatgacgtttgtcggctggttcagtccagtgatactagaaagcatgaggataggcagcgtataaacgcctaacacagctaacggttcaggccctgctgacattaacgtataaagagaccaaaggaaaaacagacagatgagtacggctggaagaaaaatagacaacactgcagacgttcggctataagcatgatgctgcatgagacgtcctcctttcagagatacatagaaggagccgggaaagctcctccatggaatgattgtttacttaatatgatcgatgattttttcaatatcatcttcaatgccaaatccggttaaaaaggataatgtttgaatcacaggcgttcctttcgtatcactcactggtgttgtcgttacgattaaatcggcgccctccgctttttgcgggacttcagatgccttgcactgttccaccacaacatcgtatcctttttcctttaacgtctcttcgacctttttagcaacaaccgttgatgttgcaaccgctgttccgcatgaaaccaatattttctttgccataagaatccctccagctcgtttattgatctttctgatctaagcccatttctttcgcatattgctttctaatatcatttcgcacccagtaccatagaagcgcataagccaaagcacagatgatggctgcaataaagtatgggttgctcggatcaagaagtctcaccatgatccaaggaatgacgtgggaaccaaggtcaatacctgaaatcatattggctccttctgggaagtcaaatccgactgctttccccattgttgtcgcaagcggtgcgagattcgttgcgataaagaagacaatcattaatgtaaaaatactgttaataagaccgcgaataatattcccacgagcggctgctactgcccatacaactgtaaacggtagaactgataagtcagcaaacggcagcatgccattgtaaggcagaacgaccgcaagtagaatcgtaatcggcaccataagaagagctaccgccatatttgccggatgaccaattacaatcgctgtatctaaaccaatatagacattttttccagggaagcgcttttgaatataagaacgagcgccctcagagattggaataagaccttccattaataacgcaaccattcttggcattagcacaagaactgctgccatttgaatacctagcgtcatgacgcccttcgcatcatatccacctaaaagaccaataatgataccaagtatgagacccatcacaagtggttcgccaaaaatgccaaaacgtttcttcaatgtttctggatcagcatgaattttgtttaaaccagggatcttgtcaatgatgcggttagacgcatacataagcggcgcgaagttgaccgtttcagcatgagccatcgatacgcctttcaatccaaagtggtgttcgattgtcggtgccgtccaatcggctaatttaagtgtgatagcagagacgatcaaaccaacagcaagtgccaagaacatattatgataagcgtaataagtcacagaggctgcgaaaatcaaatgccagaagttccaaatatccacattcagtgttttcgtaaaattaacggacaataagatgacatttaacaaaagcacaagaggaatcatcaaaggggcaacgggtgttccaaaggatatagcagctccaatcggccatccaacatccaaaatatcgagctttagcccaagggaagtaaccatggcttttgctgctggcccaaggccgctcacaagcaaattaatgacaaggttgacaccgacaaacccaattccgatcgtaataccggctcggaaggatttcttaaagccttgccttaaaatcataccgaaaagcgtcataataatcgggagcataatagttggtccaaggtctaatataaaatcgacagcttgcttgatcatacatccacctcctggatttttcgaataaagcgcttacattattttatcaaaggctattggtttaattctttctgaagcaaagcaaccgcttcttcatacgacgtcatgtcagacagcttcgtcatcacctcttcttttctaaaaagtgtcatgagcttctctaacatcacaagctgcttactaggttcagagattgctaggacgaacacaattttggccagcacagtttcatcagggctccccatcttgtgaaacataacaggttcctttaaagtcgctacactaatcgccggtttgttcacatgctcaggatctgtatgtggaattgctaccccaaaggtcgcaagtggaaggcctgtaggatatgttttttctctttcaagcaccgctggtaaaaagctcgacttaatatatcctcctacttctaattgctctgctaaatatgtggtcacctcctctctcgaagatgaatcgtactgcagcttgatcagttgttcatctaactcaaacaagttgttcaaacaaccacccctttcatttggtataaatgtgaacacatgtaacaaaaagaaagaacattttagaatagaaccttttataaagcgcttacaaatacacatatagaaaaatgttcaatgttgttacctttgtaaagatattataatattctaaattataagtcaatgttcctaggaaaaattttataaaaaaaagatgcagtcttttctgcatctttcatcaactctgctctacttcttattaaatgtgacttcttctaatcactcagtacttgctctttgatgtgagcaacaactttgtcattcatacgcaaaaagacccttagccattgaaatacattacagtctgtacttcaaatggccaaagcgtcttcgatcccctgatccgctgtgtttcttttatataaataaaaaaagaaacgccatcctcaagaggcgcttcttttcccgggaaatgttcttattgggcagagagctttaaatcgacgccaacggcagttccgtttcttgaggaatcagccactccagtaaaggttcctgcttttcgatcaatgagtagcgcttgaacatttcctatatcaataggcgaattgccgaaacgatgccccatatcattaagttttgttctcacatcgagagggacacctacttcataacgataagaagtaggactgtttgtataaattcttggttcttcaactgcatcctgaagctccatctcatattcaagcaaattcaaaatagtttgtgaaacagaagcaatgatggttgttcctcccggtgaacctactgtcatgacaggctcattatctttaaaaatgatggtcggtgtcatactggacaacggtcgtttattcggctgaacttcatttgctccgcctggtattgcatcaaaatctgttagttcattgtttaagaagaaaccatattccgggacgagaatccccgtaccaaataactgttcaatggttgtcgtgaacgacacaacatttccccactgatcggcaacagtaaaatgtgtggtctccccaatggttttatcttcaggctgcggtacaataggagatggatttttttcatcctcatacgcccacggatctccttctttcgggttaagattctttttgtctaattgaataagagaggctctttctgaaatgtaatcatcgtctaatagtccttttagtggaacatctacgaactcggggtcgccggcatatgcagcacggtcagcataggagagatgcatcgtttcagcaagtagttgatatttttcgaatgatttggggtcatattgagataggttaaagtggtcaagtattttgagcatttgcagcataaacaccccgcctgagcttggtggaggcatacttgcaagctggtatcctttatagtctccccagataggcttgtcagtctcgacctcataacgaccaatgtcatcagttgtcattgtcccgccaaaatcttggactgtatttgcaagtgcctttgctacttttccttcataaaatgctttgcttccttttttcgcaatgagcttaaatgtttttgcaaggcctggctgaactaggaggtctccttctttgagcggctgatcatttggaagaaagatgggcgctgcagccgtttttttcaattttccttgatgatcatcaatggcttttgccaagacagaatcgatttcaaatccatcctctgcaagctggatggaaggcttaatcaattccttcattgagcgggttccccacttatctaatgccgcctcaagacctttcacagtccctggaacaccaacagcattaccatgtgtggatcgctcagcaaacgggatggctttcccctcatctgttaaaaacatgtcaggtgttgcgccttgtggtgctctttctcgactattgatgatggatgtttcttttgtcttcccatcataaaccatcataaatcctccgccaccaattccagacatcattggctctgtcacattcagtgcgtactggatggcaacagcagcgtcaacagcgtttccacctttctttaatacatctgcacccacttctgatgcgagcggatgggcagtagccaccatgccatctttcccaacagctactttattcccatgagtttcgtttgcagtgacctgaccgacaggcagaaaaaacgagaaaaccaacagacatatggacaaaatagttagagaaatgcgtttcatacacaacaccccttccatattcttactttgaccataccgacttcttgaccagaatacaatagattattctaaaatttctaaaattttcattctatcatcctatattcatcaaatgtaaagtggattttcaaaacatatgacacacgtaccaagtagggataaagacactatcctttcatgtttttgatttcgcggtataataaacgcatcgcaaagggggaagaatgatgaatcaaaaaagcactttattttgggaaacatattggaaagaaaaatcagaaagcgcaccaattgacgcatctgtttccgcttgggcatttggagcagacccagatcatttacttgaccttgttctgcaagggaaaaaaacagcgacatgttctggacatcttttttacgaaaaggaacaggagccgcttccaaaggcagggcaatatgcggtcattttggacagccatgacgaaccaaaagccatcatagagatcacgcatgtagatgtcatgccaatgaatgaagttccagaatcatttgcccaagcagaaggtgaaggcgatctttcttatcactattggtacagagcccatgaagcatttttcacagaatcactcaaaccgtacggattagaatttaaagaagacatgctcctcgtttgcgagcgatttaaacttgtttattcagcttcttaagctttaagcggcgccaaaaaaggaccgcttttttcatttcttttctcctttctgaaaaaggtgtgatgagaacacatctttaggtcagaataagatcaaatagaaaaagtgaagaaattttcgactacacctgttttttttcgacaaaagaatatataattatttgatgtgtgcattgtctcatttatacaatggagggtttttacatgttaaaaaggaaaaaagacaagttttccgtcttgttaacggaaattgctaaaaatttagatgaaactgctgagtattttgttagctataaagtaacaaatcaaaccactctgaaagaattttctgacacattgaaggaatatgagacaaaaggtgataatcatgttcatactatgattaaagagctgaacaaagcctttattacaccgattgaacgtgaagacattcttcaattgacgaatagcctcgacgatgttttagatggaattgagcatttttcagcgacaatggaaatttattcaatgacaagctctgacgaacatatcgacaaattcagccactacatcagagaatgtgcgaaggaaattttaattacaatcgatttactggctgaaaatcgcttaaaagatattcaaccacacgcaatcaaaatcaaagagatcgagcacaattgtgacaatctttatcgtaaatcactcaagaacttgtttggaaaagaaacggatccaatcaaggtcattcaatacaaagaaatttacgaaacacttgaagaaattgccgattcctgtcaaagtgttgccaacaatctagaaacaatcataatgaagaatgcgtaacggggttagttaaacatggacacattactcatccttaccatatttattgtcatttgtgcacttgcttttgatttcatcaacggattccacgatacagcaaatgccattgccacttcggtttcaacaaaggcgttaaagcctagacatgctattattatggcagcgtttatgaacttcttaggagcaatgacatttacaggtgtggcaaagtccattacaaaagacatcgcagatccttttacacttcaaaacggttctgtcgtcattttggctgctttaattgcggccattacttggaacttgcttacttggtattacgggattccgagtagttcttcgcatgcactgatcggatcaattgcaggagctgttattgcctctgctggttttggcgctttaaactattcggggttcattaaaatcattcaagcactgttgctttcacctatcctagctttcgtattaggatatatcgtgtacaccattgtcaaatttatatttagaaaccacaatctcgcaaaaacaaataaacaattccgtcgtgttcaaattttaactgcagcactacaatcgtatacccacggaacaaacgatgcgcaaaaagcgatgggaattattacgatggctttaattgcagggaatttgcatacaacagacgatattcctttctgggtacaattctcttgtgcgcttgcaatgggactaggtacgtctattggcggctggaagattattaaaacagtcggcggtaaaattatgaaaattcgtccagtaaacggagtatctgccgatttaacgggtgcagctattatcttcggtgcgacatttattcacttacctgttagtaccactcacgtgatctcatcttctattctaggtgtaggttctgcacacagagtaaaaggggtaaactggggtacggcaaaacgtatgcttgtcacttgggtaattacattaccgatttcaggaactctcggggctcttatatactttgtgttaaatgcgattatctaatatcaaagacctgtctgacaggtctttttttatttgtctgcacccttttcctacaagccattttttcatgaagcagggtttccaatcatatccatagaaataaagtaagtatccatctgtctatgggagagaaaatcatgctattattttttcaattgaccgtgtggttattgctgggtgcccttgctgtatatgtatttgccgtatggcgttttgaacaaaaagtaaaagaaaagatgtttgccattcgtaaaacgtggtattggatttatgtagctggtgctgttgtatactggacaaatgacccttcttcaatcttcaccgattggatgcactacttgattattgccgtttttttcgcattaaccgatgcattcatctttctcagctcctatattaaaaaactcggaaatcacgaactagaaaccgacacccaccaactcctagaacaaaataacgatctacttcattcttacctcaataaactaaaaacgtaccaatacctattgaaaaacgaaccgattcatgtatattatggaagtgtagaggcatatatagagggaattgaacggctcatttattcttttgccgacaagatgaatattcaagcagttctttgtccttacgatacgcaggaacaaaaagatgacctgctccggacacttgaccagcgagctcttattcaggcgaagcttgacaggcaggaagtctattacgatgatttcggcaaattggtgctcatcccgttttctgtagcagatgatcacttcgtcattaagctcacctctgatgacattgtcactgagttcgactatttattaatgacatcacttacaacaatttatgacctaatcttgcctgacgaagaggaaggtgatgaagatggaccacgcacttcaaggggataacaacaatcgcaagaaaaacccttttaagattttaaagaaaaagcaacatatcagtatggcggattacaaggtaagcccccatacagaacgtatttttaaaaagaatgaacagctattggatgagtataaaaataaaagggcatgattacactaaaggacgcggaacaaaatccgcgtcctgcttccatttttacatagacttgcatacaataatctatacgctgcaacgattgaggtgccaataaatgaaaaagaaaatcaaacaattgagatatgttcagtttgctgaatttaagtcgtcgccttatatgcgtcgattaaatgaacaaagtgaagcagtcatccaatcatccaaacagaaacactcactgatttaacagcttcagaagcttttccttcgttttaggtccgtataccccatcacttgtcagaccatttaccagctgaaaacgcgctacggcgttcgccgttttttctccgtaaactccgtctattcctttatttgcagctgctttatcaggataaaaataaacagcagcaagcgcctgctggacgaggcgtacgtgctctccctttgtcaatggagaagtcacctttaaaaccccatctggcagctcatacaagctctttgcatcgttacgataaattttgagaacttgtccaatttgaatcttattcggatcactaatgtcattccacttctgtaaatcttgaactgtgaccccatgagcttttgcaatactcgttaacgtatccccgcttttcacgacatatgtgatgaccgtctcaggatcttctgctgtttcaatcccttttttaaattcattccaagtagatagaagctggcgtggacatgcttttcctgaccagtactgatgtgtgaccacatttgctagcggtatgtgatgttcttttaacagcttttgaatgagccattgtgcatgtttgaccgcttgctgaaaattcccatctacattctcacaaatttcaattccgatcgacttccggttaccattcccatgaccatcccctgcatgccaaccattttcatttaacggtagatgctgaaagatttcatgatcatccactgtaaagtgccagctcacctctgtcgttgggctttttacataggccgcatgacttttcgcatccgctccctttgacgtgtttgctgtgttatgcaccgttacatactccggtgtcatcgcataccctgggcggtttccgtttccaactggaataaaatcttgataaatttgtaccatgtactgcactcccttttgctagattgaattgatctttctcatcaatcggtggcattcgtaagacaatacttgtttgttttcatgagaagactatggtaaaatttgaattcaattcactctttttagtcgtgaaacgtgcaaaaatacagaaaaaaacaggaattaattccatttttccttgattttatgttaaaattgttaaaaataaaccgataataaaagtaagtaatagctcatttagctatttagtcctatatggacttttcttttacgccaaaaatagaacatacgtttgtatggaggttttcaaatgactggttttttaacccatttagaagaagatattaagcgtttatatgctcaattacaaataagcggtcctgcttatagagagatgcaaaggatcgcttctgaatttcgcgtatgggtccattacgaggagactggcagcatgatgatccagcatcaaggtctttacagtattatcttaaacagatccctatcacctgaagaacagtggcaggattttgcccacgagctttgtcatgtgctaaagcatacaggcaatcatttcaaaatgaacaaactctttcgagaattgcaggagtttcaggcaaaacaattcatgtatcacttttgtgttccaacctttatgctgatgaaaatgaagcttccaccccttcggcagcaagccatttttcatattgctcaaacgtttcatgtcacttggacttttgctgaaaagcggcttgccttattcgaacagcgaaaagcaggtattcgctttcagcaggagtttacgtcttatttaatgaaagcagaaagagtcgctgaaaaagaagctgtttatcaaacgtaaattatcgcataaaagtttattcataaagagctaatacttgtttgagtacatttgtgtaccgataaaattgttcagtttgtgtatctcgccggtattgacgcctaaagtcttgaaagaatgctcttctttgcgcctgactaatttcaagttgtacactttttcctgtcagacatttgttattgatattatcaggatgcgttccagaaaaacgatcagattcagctagcagcaatgcgtgaaagccatttagcgttaaacgcttcacagtttctgccgctctttctctatctgtacctcccactaacgtttgaagcacctctgtttctccgtagccatgaagtgcaaacgtataatgatgggtatgcacctctgaaaggcaaagcggctcatcaaagcgtgtacttgtaatatgaagcacatgattgccttttactttaaggccttcgaataaatacatagaatagtcactagaaatttcatgaacaagctcactcacgcctgattcaattcctccagcatgaggagacaaaactagcagctggtcacctttccgctcgtgaagaatttgataatcaatcccttttctttcatgagcggagagctcttcataattttgatacgtatcgataatttgcatcatgtcatctgctccatttctttatatgagcataagtctactgatccctcattcttttgtaaagaggtttcgaatcaaatataccacttgaattcttccttaaattttccttacatttacggcattctgttgaattttgagaaaaaatgaccgataattgaaacgaatagaacttttggactatatgaatctttttgtattctctctcataaattagaaatattgtgatctacatctggaggaattcatgttaaaaaagaaaaccaccctcactcttatcatcttactccttagcttcgctggcattatttattggaaatgcttctctcttcaaggcgtgtctcacggaacattcatccgctcgatgtcatcacctgacggaatgtatatcatcaacacctatcagcatagcggaggaaagctaaaggaaaacgcagtcagagcagaaattgaaaacaaactgacccaccgcaagaaaacgatttactggaaataccctgataaggaccctctcatcaaatggaaaaacggacagcttgttcaaattggacatgagtttttaaatgtggtgaaaggcgacacctacgattatcgctttgatcagaacaagagaaaataacgacatacaaaaaaacgaatcctcttggattcgttttttacgttgccatgacggtttgcataaatttcttcatatctgtactaaccgttgtcaatcgatcaacaatttcgctaaattccgtcacaagtgaagcctgttctgatgaagaacctttcatatggtccatactttcaagtaatgtatgtatattggaggaaattccttgtaatgagctttcgatgttttctgttgcacgtgaagtttcacttgaaagcttttgaacctcacttgctacaacactaaaacctgctccgtcttttcctgccctggccgcttcaattgacgcattcaatcctagcaaactcgtttgtttcgagatgcctttaatcatttttgtaatatcggctgtttgtttcgagctttcaagagtttgctgcgtttgtaaggtcatctcctcacttgtagcagaaagctcctctgaatgcgccgccaccacgtgcaccttttcttgaatactttgaataatgtcattcaatgaatccatatacgcttcaagctctatttgatttttgagcggaaatcctaaagcgagggcaccaatcacttgcccgttttcatcaaaaatgggcaatcccattgcatttaaaggtactccatatactgattcaggcacaaacatactcgatgtctcacctctcagcgcttttttcatattcagatcatctggtttaatacgttcaccagctcgaatttgaaaatcaacatctttcgatggcaaatacagcaaaaatttctctcggtcaatgacacccatcgtcacttcattttttaaaatctgcatcatataaggtgctgctgtcactatactctgtagtatatccaatttctctacccccttatattatttatcggtcgcttttcttaaaataatagttattttttaaaaataatgatgatgaaagttatttctcatatgtatgagtaaaaagagggaaattccctctctatattcaacaaaacgtaaatttgctataatttaagtatcaacatatgatgaaatggtcatgtaatcattttatatatattcattggaggcgcatgttgtgagacaacctatgacttatgagcgggcgatcgtcattggcggcggtatgacgggaatactcgctgcaaaagttttatcaacgttttatcatcaagtttttattatcgaaaaggacgaaatgccagactctcctaagaatcgtctcggcactcctcaagcttttcatccacatagaatgctgccactaggcaagcaaatcgttgaacgtctattccctggctatacaaaagagttattgacaatgggcggatttaatacatggcaacaaacctctcgatttatcacaaaagatggtgaattaacgcttactgatacagaagaaacagccgttacaagacgtgccatgctagagtgggtgctaatgcaaagaatgttaaatgagggacgggtgcaatgtttagaaaaacatgaagccttctcacttcagttgaaagagggaacgaatcaagtcatcggactgatcgtgaaagatcggcatcaaaagccgggacgcatttttgaaatgaaagcagatttagtgatcgatacgtctggaagaatgtctaaattgccaaaatggctgaaagatgctggactgaccttaccgcagacagatgaattaagtgtgtcactcggttacagcactagatattacaaaataccaccagaagcgccataccagcaatcaatggtcgtcgtgggtcagccagacaggcaaattccaacaggactgtttgaacgcgtagatcatgatttagtagctgttcttctctctgcagctggcggatcacattatccaacaacggatgctgatcaatttgattcagaaacggctgcactcgcgcatccagcaatagcagaggccatcactcatttaacgccctatacaaaaccaaaagggtttagagttccttcttgcgtgagacatcactatgaacaaatgcacgaatggccaagtggattattggtgatgggcgatgccttgtgtacattagatcctattcacgggcaaggaatgacaaaggccgcactcgaagcacaagttcttgagcgtatgctcaaacaagcacaaaaaaataagcagctatcttttgaaaaggacacattacaacaaatgcagcatgccaatgaacttggctggtggctttgtgcgattgctgatatggcgtgggaaggcgttgaattaaaaggagaaacaaccattccccatttgacgttcgtacaaggatttttaaatcgttacgtacaatatgccatagtaacaaaacagcctgaacgtcttgaggcgtatcaccgaatgcattcttttttaactgaaccgagagacatcatcaacttagaacagctgcatgacatgattcaagccgacacttctggcgaaacggctgaatggtggagtcagtggaatcaagaggacgatgaacgcaatcgggcttttttccatgaagcggttcctgactttcgtttacagcaactactgtcattcaattgaaacaaaaaagcccctttaaggggctttttgattaacgtaataattgaagtacgttttgtggctgttggttggcttgtgctagcatcgcttgagatgcttgagaaagaatgttgttctttgtgaactcactcatttctttcgccatgtcaacgtcacgaatacgagactcagcagccgttaagttttcagcagaagcaccaaggttgttgattgtgtgctctaggcggttttggacggcaccaagtgctgaacgctgtttagatactgcgccgatggcttcatcaatttttgctacttcaacgtcaaagtcaaaaccatcttcatttactttaatatctttgacagtcaaggtttcagcgtccattttgccgatctgaacgttgatgttttgctcaatgttagcgccaatttgaaattggaatccatcttcaacgctaccatccaacagattttttccgttaaatgctgtacgctgagaaatcccatcaatttcatctaccaaagccgtgagctcttcttgaatagctgttaaatcttctgtttgttgagtcccaacgttacccgcttgaactgttaattcacgcatacgttgaaggatcgcatgtgtttcagttaatgcaccttcagctgtttggataagagagataccatcttgtgcgtttttagatgccatttctaatccgcggatttgtccacgcattttttcagaaatggctagacctgctgcgtcatctcctgcacggttgatacgaagaccagaagaaagcttctccatgttcttttgccctgctccattgtttgcagacaaacggttcagtgtgttaagtgctgcgatattgtggttaattctcatattaaatgacctccatgtgtttgaaccaattgaacatccttgtccaaaagttctaaattagaatttttttgtaagccttacaatccatttatcgaactttaatggaatttgtttaacaaaaaagggataaatgaggtaaaagtctcattcgttatgatcgtttcgctagagtatgccaaatctaaaggtcatttttcatgatttgtcagagggatttaagaatcataagactggagaaaatgcgaagaaaaaacagcataaaaaaaagccccataaaaggggctcttcattaacgtagtaattgaagtacgttttgtggctgttggttcgcttgtgcaagcattgcttgagacgcttgagaaagaatgttgttctttgtgaactcactcatttctttcgccatgtcaacgtcacggatacgagactcagcagctgttaggttttcaccagaagcaccaaggttgttgattgtgtgctctaggcggttttggactgcaccaagtttaccacgctcagaagatactttattgattgcagcatctactttgtctaataaagcatctgtattagcagctgtagcagttgttacaacataatctgctttcaacatatcaagaccagtagcagcagtacccatgttaccaatattaacagttaattgttgagttttgttagcaccgatttggaaagtgaatccatctgtagccgtaccatcaagtaattttttaccgttgaatgctgtacgattagagataccatctacttcatctaaaaggttgtcgatctcatcttggatcgctttaagatctgtagttgcatcttgcgtaccagtgttacccgcttgaacagttagttcacgaacacgttgaaggattgagtgagtttcagtcaatgcaccttcagctgtttggataagagagataccgtcttgtgcgtttttagaagccatttctaatccgcggatttgtccacgcattttttcagaaatcgcaagacctgctgcgtcatctcctgcacggttgatcttaagaccagaagaaagtttctccatgttcttttggcttgaagcgttgtttgcagacaaacggtttaaagtgttaagtgctgcgatattgtggttaattctcatttcctattacctccatgtatgtgggacctgacagacgtccttgtctgaaaaaagtcctttgttctagggcttatcaaccctgacaattctattatcggacatagttataggatgtttagcagatttttaaaaaaatatcgtattttttcatgatgttgatcctaatttgaacaattctataaaaacaaaagctgctgatctatcatcagcagctttatcgttttatgaatatcagtattgcttgatatcaaacattaagatattttggtacaccacataatccttcttacttgtaaaaggccctttattatgctcatcattgatttcatagaagttcatcccaattccaaaacttctctctttataccagtttagaaaatcgttaatttctttcattgaaagcaaataatccttttgcaacccgtttatcatggtaattgaaagtataccttttgttacttcttcacctggctttgttccgtcctgatctttcggttcttcggttgtgccatcactaggctttgtcccgtcctgatcttttggttcttcagttgtgccatcactaggctttgtcccgtcctgatcttttggttcttctgctgtgccatcacctggctttgtcccgtcctgatctttcggttcttctgctgtgccatcacctggctttgtcccgtcctgatcttttggttcttctgctgaaccatcgtctggctttgtttcaccttcagcaatttgcaagtcttttaatgagatagagattactgatttgtaatcacttttaatcgattttgaatgataatcttgcttgaaatttcgtccacctatgatatatatggtatcctcaatcgttacagcacttgaacctactctagcttcaggtaaattgatcgagcttcttttcacagaattcgttttagcatcataaaactgtgtgtatggtgataatagactggatctgtcgtcatactgtcctccagccataaacaatttcacctgatatgtcgtaaatgcagcccctagttgataaaaatttaactttgatttcgtttgtacccattgatttgtttcaatgttatattcatatacttgggcattatggagattactaactgttctttctccacctgtggcataaatcttgttgttaatgacttctgacatagacataccagtaagttgctgaggaaacatttttaattgttgccatgtatccgtttttgtatcataactataaaaattatgttcttgataaggacttttattcgttgcaagaatataaatcttatcatttacaacactcgcgcttatatccccttttgtcacagctaggtttggtatattaattggtgtttctgaccatgtatcggattctacatcataaatatcaattgtttttgtgctatcttgatatgctcctccaatgacatatatttttttccctatcgccactgccgcactatctgttctttctcttggcatttcagcttttgaactccactcatttttgtcaggatcatacatgtaggtatttttattactatgtgatttttcactacttcccccaaaaacaaaaatcttcccatctactactacggaacttgaatgaagtctctcttccggtaaatccgctcgcttcgtccagccatttgcctcagctgcatcagcttttaacggatgaattgtgaccatcataaaaatggtcaaaagcactagaaataatccttttttcatcatttttttcctccatatcttaaatagccctcctcttatcgacatatttgtaataaaatttaatttttatcactgtttactagaatcagcatttcctgttatttaccttcacacatacatcaccggcgtcgatattttaataatcttcccgcctcgacgataaaatcttgggacgcggcggcttagggtggcgatgacttcgtagttgattgtattgagcatttcagcgatttcatcgacagaaatttctccgcccttttgacgtccgtatatgacgacttcctcgccttgctttgctttcatttctcctaaactgatcatcgtcatatccattgtgactcggccagcaatcggcattcgttctccgcggaaaagcataaatccccgatttgataaagcacgtgagtacccatctgcgtaaccgattggtatggtggcaataacttcatcaggctttgctacatacgttgccccatagctgacggtccttggctttgtgaccatttccttcacgaacgcaattctcgcttttaaactgagagccggctctagctgaacagcgtctaagctttcaatgtattgcgagggatacagtccataaagtccgatgcctagccgaatcatatcggcgctaaattcaggaaatgcgatagcagccgctgtattgttcatatgtacggtcggcagcttaattccttgttttttcaaaaagcgaagaaaatcaataaaaatactgtgctgcagcagcgtgaaatcaggatcaggctcatccgcagtggagaaatgcgtaaaaattccgtcccatctaaggtttccactcttttcgagtgcctccactacgcctaaaagctcttccttcgttcgtacacctaatcgtcccatccctgtgtcgacattgacatgaatcccaagacggtgctgactttcttcttctgctaagatctcatttgcttcaacaatccagtcttcacgaaggccagatagatcaattctccaggccgtagcccttttcacacagtcgagcggagtaaacccaagaaccaaaatcggcgcttcaatttttgctcttcgcagcacaatgccttcctccaagctagcaactgcaagctccgtcgcaccgctttctagtgcctgccgagctacctccactgagccatgtccataagcattcgccttcacaacagccatgatcttacttttcctcggaatatgcgcttgaatggcttcgatatttcttttaatcgcatcaatattgacttcgatccagacttccctgcatagctttttcatttatttttcctcctcatcacatgagcgttctttctatatccatgttcgcttttgtgtctagtctatctttattcatttttgagaaaaacattcagctacaatgactgaacctgctttgtcttgttgcacataaaaaaagaaaccacatcaactgtgatttcttctctatgtgcgatgatattcaatttcatccgcagatttcatcattgcatcaatatcatgataaatctcctgcaaattttcccgttcagctaagtattgagcattgcttttatgaacaggcacatcaaattgcaagaagttgatcgtgatcgttgatgactctcggtcattcattattaatcttaattcaagcgttgagacctcttctttatcatctctctcagctgaagcaatcggcaccccatcttctaacatcacaacttgtttcaaatctttcaaggatagctcagttactgcaaatctatttttactagttgacccatcaggctgatgttcaataaagcgcattttctttaactcatcatcaatcgcaaatcccttatcaacttgctctgagaagaaataggtagatgcttgaaacccatcttcgtgaaaaagcatcatcattttgtccattaatatgtttggatcattctgttcttttcgcctttctaatctaccggcaataaataaaatgaccattcctccgatgatgctgagagccgttaccaatccattccctacatctacgaaaacagtaaaacctaaaatagcaatcataaaagcaatgataatgcctatgatgaatatcacacaatgctcctcctatcatgacccttcatgaatggtttagccatagtatagcatttgaagtaaggcgatttaagaatatttatatgaagaaaacagaccatacagatctgctttcccattgaacttcattcaagtgtttaaaagataggcagtaagaattcacacacgccttcttcttctctatatctctccataatagatgcctgacgcatgttcaattgattgttttggatcatttgaggcaattgactccaaaacaaattcactttttcggttgtatgtgtcactgtaaacacagcatactttcccccttcaaaatgtccagtctgaaccatttgatcttttgagaaaactctatttgtcatcaacatgaggtcgtatctgcatttttctggtgaaattttcccaggatcatcttgaggaacaccatatataccaaacccctttaattcatcaattaattgatgttgattgacccattttttaaatctcttcatcatctctacagtttctttgctgccatatggtcctatatttctcatatacaccattttcatattcgttaacatttcaattttgtaattcatgatttccctccaactcttattggaagattggccaatcattccttacatccaacggtaacatcctttaaaatataatacagcaggttattaaaaataattgaattatgttggaaaaatattcactggaattgcgatttagatcataaattaagtcatctcatcatctctttaaatagcatatcccatttttaaaaataaaaaagaacggtctttagccgctcactggtttattgattttcctttgaagatttagcaaagagaagggtaacaatcaaatagataattgttccgaaaaacagaccatttaacaagctgataaacaacatcttacaaaccaggccaacataataagacactggtgtccctggaaacacagccatattgaacagactaatcataaaggttaaagcaaaaaatataatgaaaatctttcgaaatactgttgattttaacattgtcatttcacttcctcctcagtatgttttctatggagaaactattctttgttcatagcgtatattccgttttatagtaaaaagcccttaaagggctttttacttaagcagtataaccaatacttgcagtgtgacctctcctagcttcatcatgacttgctgtcacttcagacgtaaaataaccaacaacacttatgacactaatcatcacgaataccactgataacgttttaaatttcatactgacagtccccccgctttacttgagtttggaaataaagaatcttttcatagaaatgcatcgcgttgtctttatctcccatttcattataatattttgcagcatcttttgctaaatcttcgaggtcaggatacattgactttacttctaacaattccattattttttccaactgctcaaaattgttgtcaatgtatagagatcttaaaaacttgaatatcaataatagaacatggtctttcagcttttcagatagttctataccgttatttaatgcatatgtacctaagtcctgttctttctttttgaagtaggcttttgacaacataatgagcggatctaagattctatttaaatgctcgtatccctgctctttaaatgctcgaattgaatcattaaaatgagtaatcgcttgtgctaattctttgttatgaaaataactcaaccctaaattataaagtgctgatccttttaatcgttttgttgagttgtcggcggctttttctagtgcgtgttgaaaatggggtatcgctttttcggggcagcccatatcgatatagtttaatccaatcacaaaagaacattgaatttctctcactgtgtatgtatctttttctctgtaacagtctatcgcctgtgcaatatggtgcatcgacatgtgggtttgtttcatgtggtaataaatttctgccatcttgtaattgaactcggcacgttcaatatcgtcgctgacaagagacagctttttttctgcccgcttatagaaggtaatcgcatttaggtattcatagttttcaaattcatacatgccgtagaaaaaattgaaataatactcgagcaatcctgttaatttctcttgatcccttttgatcttcagtgcgagttccctaaagttcgcccgctctttcccattttctaaaggattcaagtaatcaagcattaatttatgtctgaactccataagtgagaaatacaataataaatcttgattttcttccatatgatcaagcattgatttgatttcctctttatatgcttcggcgtccggtacgttaaatcgttgaatgtgataataccattcattgattttcaaaccgacgtgagaagaaagcactttctccatcagcccttaccccttcctctattttccctataatgacatatattatcatttcataaatcgtccggcaccgaaaagaaaccgcaaaagaacaaaaaaagcttctttaaagaagacctctcctcctgtactctctaatgatacattcaggtctacatctagtatatccttcacgtcatacttgttttaatcgtttccatttacgaatttgagtacggaaatttttaaaaggggcaacggtattcacatgaataaatttataaactggccagacagcctttgctgtagcgtcatccgcccattttcgttgatgaggttcaaacacttcttcttcactcatacgatctaacatattacaaatagttaaaacattctgtttgagctgagctcttaatgcgacaagtgattgacaagcatacttctcattaaaaagagaatataatgcgccaagctgattccatttataaccttctgctggcgtatggacaaccattccttcagtttcgtcttgctcccattgaagtagcagggtagtccagccaacttgataggccaaattttctgcaggagttcggattacatcctctatttgatcatctttcatttcttctgggatcatatcgaattcttcatcgtattgattgtacgatttcatgattgcttgctttaaaacatcttttgactcatagcttgtcatatgactcacctctaattctttttgtgcaaatttttctcggaacatatcttgcaaaagtacaaaaaagtaactgtagctcatgatactgaaattattcttaatcgagcgaaaaagcaatagctcaataaagtaaagctataaaagcggctgcgaaaaaagaagacactctttacgttccatcataaacaaacacccagtatctctccccaggctccccttcttctacaacagccttccagcctcttttttgataaaaagtcaaagcgttgtgattgtcagagacacatttgagtgtgaccggtgttccgagcactttgatagcatgtttgagcagcagatcaccagccccttgaccagcagcttttggatgcacaaacaagagatgaataaaacgatctggtacatagagcgagatgaatccgaggattttgttgttgtcttcagctaagaaaatttgttcttccagcgtatcttgatcaaagtcttgcagattgatttcttctgtattaagccagtgaaagctctgacggcgggatgctaaatagatttgtcttaattgtggataatcttctatgcttgcttctctaatcaacatcgcatcatcccctatgttttttaaatgttatgtcgcctctagaatgtgttttgcctgtgttctgcctgccaataacaattgatcactgaactgcgaatcattgacagctcgtgcaagagcaattgtaccaatcatgctgcttactagtgcgtaactcttagagagatctatgtttccagcatcagctataaacgccataaatcgtttcagttcatcagtataaactttccgtacctcttgcgataattgagaaatctcccctgcaagcgcaggcagtatacagccgacctccgtctgatcacggtgaacggaacttaaatagaattcaatgatcgtctgaattcgaggctggtctgctttcttgtctgcaacactttgcagcagctttatcgtatcagtaatagcaaaatgaaaagcctctatcaccaactgatccttgttcttaaagtgagcgtaaaaccctccatgagttagacctgcccctttcataatgaatggcaaactgatattacgaacgccatttgttcgaaatgctcgtgcagcacttgcaatgatttgctctctcacttttgacttatgacctttcggataaggcatcttcttactccctccttcactttaactcttgctaagtgtgtttatcaaaatattataatcatcatattttcgagtgtcaaattgactaaaatccatctttcctcacttagatgggattgactccaccaaaatatgatggatataatatattatgatcatcatattttgaagatggaggttcaagaaatgattcatttagaaacagtagatacattagtgattggatcaggtccgggaggctacgtggcggcattacgttcagctcacctcggcatgaaaacagcgattgtagagcgtgatcaattaggtggagtgtgtacccatgtaggctgtatcccatctaaagcactaatagcagaagcagagcggttcaaactccgcacacaatggggtggttgtcaagaaggcggctctttcaatgaagctcaagcgttcaaaaaagctgttgtggaaaaacaagctggaggcgtccaatttttgttaaagtcagcaggatttaccattctggaaggcgaggcaaatttgatcgatcagcatacagcggtaattcaacatgcggaaaaaggtaaaaagcgaatcaacttcaaacacctaatactagcaactggttcccgtccaattgaaatgagatcactccctttcgggggtcgtatattgtcttcaactgaggccctatcccttcctaaaattccgaaaagccttgtcgtagttgggggtggttatattggggttgaacttggacagatgtttgcaagatttggagcaaacgtcaccattttggaaggcggcaatcaagtattgcctggctttgaaagtgaacttgtttcgcctgttgttcgacaattgaaagaagataacatcaccctgattacaggagcaaacgtcacagatgccaagcagcatatgagcggaattgatcttcattatgagaaacagaaagaaagctacacggtgaaagcggaatatgctctgattactgtcggaagaaaaccaaatacagatggtacattaggtcttgattctatcgggttgtctattaccccacacggactgattgaaattgatgaacaatgcagaacatctattccgcacatatatgcccttggtgatatcaccaagggtcctgctctggctcataaagcttcctatgaagcgaaggtggcagctgaagcaatcgctgggaaaccttcgataatagattataaagcaatcccacttgttgtgttttcaagcccagaattggcgagtgtcggactgagcgaaacagattgcaagcaacaatccattccgactgtcattggaaaatcaatgttctccattaatggtcgagcgctggcactaaaagaaccagaaggatttgtgaagattgtagcccatgccgaatctggccttattttaggagcacaaatcgcaggtacagaagcatctactcttatatcagaactttctctctctattgaagttggtgctacagtagaagatttaacaatgacgattcatcctcacccaacattaggtgaaataatcatggaagctgcagaaatggccacccgtaaagttgaaaaatatctatcacgataattgtttaatgtgtagtttctacaattgagcaaaataatcgccatagcctatttatttaggaataggctatggcgatgtcaaatgagtattgatattaaaacgtcggtcaattgatcattaattggattctacttcgcgctttttaccgagattcatagataactgaacgccaatcatcagcatgacgatgacaagcattgccacaatagaagcataaaaatgtccgcttagatcgaaaactaagccaatgaaaaacggaccgaatcctcccatgatatacccgcccatctgcgacatggcggaccaagttccggcttcctctggagtacgcgtctctataatcggtagcatgagcgctaaaggaaataatccacctgcccccatacctaggaaaatgacagctggcaagattggcattggcaaaagaagaaagatgagaccaatcagctcagacagactgcataagatgagaaataatttcggttttcctaatcgagtaacgaccgctggaacgagtagtgccaccggaatctgaatgagtgtaaatatggtcagcagcatggcagcatattgcggactgtttccgaaactaagagcaatcggtgaaatccatgccgtcaaagaataaaacatgctggacataaagccaaaaaacaaggtaaattgaatcgcctttttgtttcgcagcggcaattttagcggcaaggtaacaaaatcactctgctcatttttgcgagcaatacctacccagagaataagcgcgatcacccctagaatagcccagcaagacaatgcaaacggaagatggtgactgcgcaagtaaatcggaatggtgaagccggaagcaagtgctgcacctattgtcatcgaaatggaatacacactgacgataccaggatttctcgggaaatactttttaataaaactagacaataaaggacccgcgaagctaatccctacccctcctgcaaatgcagtcataagcaggatagcgactgattggcttgtaccccgcaacgctgtagcgatcgtgatgagaagaatcgagaaaaaaagcgttctctctaaaccaaatcgccggctgagtgtcgtcgcaacgggagcaaatacccccatacaaaggacaggtaaagtggttaaaagacttgctgtcagtgcgttcacaccaagctctgattggatcatactcatcatagaagcgacggacgtaatgattgggcgcaagtttaatgcagctaaaaataaagcggctaaataaaatatttttttcatcaatgcacttcttcctctctcaacttgttgaagttactttgagtataaatccgccgcattcattgatcaatacaataattcgtattatgatgatagtaaaaaactatgattaatgaaaggatgacaaatggatactcggcatattacatatttcatggcagtattcgatcatttacatttcacaaaagctgctgagcaattagggatatcacagcctacattaagccagcagattcggttgcttgaagcagaagttgggatgccgctctttgatcgaatcggcaaaaaagtcgttgcaaccgaagcgggttctctgctttatcaatatgggatgaaaatgcttcaagctgaaagagatgcaaaaaatgcgatgaaagaactattatctgaaaaacgaggaaacgttcgacttgccgttctcccctccgatcttgactttcagcttgttccgctttttgtagaatttaaaacactttatcccgaaaccaatttgaaagcatattcaacgatcttcgttcgtgaagaagtactgtcgcataaagtggatctcggcattgggctgcgagggcctgcggataagcggctcattcaaattccacttggaagtgagccctacgaattatttgctcattcagaaagtgaactagcccaaaaaagtgaagtgacattggaagagctgacgcagtatgctttggtcatgtatccgaagggatatctaggaagagatttagtagatgacgtatgtaaagaacagggtgttgaactagacactgtcatggaagttggttccgcatcttcattattgcagctggttgaagccggcatcggtgcaaccattcagccgcgaggattgctgcaacaacatgcgacatggtcaaatattgtgtcgattcctattgctgatccggcacctgttcgtcacttagaattaacttattatgcagatcgatttgtcagtaaagcacagcagcagctatcggagtggctgattgacttttttaaatcaaaaacaaatgaaaaatgaggataaaacatgaagaatgcaaacagcgtatttacaagaacaaaccggatagtaattcgtcaatttgatctacaagatattgaggcattttatcagtatcgagcaaacccctctattgcaacatatcaatcctgggaaaactatacgtatgaacaagctgaatcatttgttcagcaacaaatgacgcaaacacctaatcaaccagggacatggtttcaatacgccattgccttttctgaatccaatcaactgataggagattgcgccattcatacacttgaaagtgagcctagaatcgtcgaaatcggatttacactcgcacctgaatttcaaggaaaaggctatattcacgaagccttgagttcaatgatcgaatatattttcactacactgaacaagcataaaatcattgcctttactgatgtgcgcaatgaaaaatctattcgagtgctggaacgtttagacatgagacgcgaaggacatttgcttcaaaatgatatgtcaaagggacattgggttgatgaatatcaatatgcgattattcaatcggagtgggccgcttaagcggcattaaaagacgctcttgataaaccttctatatacatatagaacttttctataacgctcagcatgctttctttttttataatagaaaaaaaagaaatgtggtggcgtatatgtcttcaacgatcggaatcatgggcgggatgggtcctttagcaacggttgatctgatgaaaaaaatcatttcacatactccagcgataaaagatcaggatcatcttcatgtgattgctgataattatccccaaattcctgatagaaccaatgccatatttgggaaaggcgaagatcctacagaatatatgattgcatcagctaaaagattagaacgcgcaggagcggactttattctgattgcatgcaataccgctcacttctttttagaaaacgtacaacaatccactcatatccctatcatgaatatgccattagaaaccgcaaattacctaaacaaacatcactatacgtctgtgggcttactatgtactgatggcacattaaaaaccaagctctaccaaaaagcttgtgctcatcacaagattgacgtcatgaccccaagtgaagagcttcagaaaaatgtcatgaatgggatatatgcagtgaaagcagggaaattgagcaaaggcgaaagtgaactggcattagcttcagaaattttaatcaaccaaggagctgaagccatcattgccggctgtacagaaatccctttagttctaaggccaaccaaagctgtgaaagtgattgaccctactgtcattttggcgaaagaagctgtaaaattggtgtatgagcttgaaaagctaaacatttaaagaacgtcatataaggggataacatgaatattgagaatatagaagcgtttatttatgtatgccagctaggcagtatcaataaagctgcagaagcactctatttaacccagccttctgtttcggcacgtattcaatcgttagaaaaggaattagacctgaaattatttgatagacagagaaataaattatctctgacggaaaaaggtgaacagttttacccgcatgccaaaaaaattctccattcttatcaagaagcaaagcatagtctcaaacaaacgatgatcccttatgaattgacaattggatgcgcatcctctatttccaataatctattgcctaacatattgcccgccctaaaagaaaaatacgaaaacctgaaagtgaaaattgtaacaggacattcaaaggatgttgtccaaaaagtgattaacaaccatgtagactttggcattgtcaggactgaaacgcatcctcaaattgaatcactcccaattttcagcgatccaattgggctgttcgtcccaactcatcacccgcttgccggccttgacaacatcaatatgaaagaactagaagaacagccttttattttctttgactatgggtcatttgattggttgatgcttcaccgattatttcaaaaaaacaacatcacaccgaacatttccattgaggttgatcatatggaaaccgcaaagaacttagtgctgcaaggaatgggactatcgtttctacctcatcattgtgtgagaaatgaggtagaacaaggaaccttaaaacaaatttcaatcgatccatccatcaatttcaacatcaatatcgagttcatttataaaaaaggaaaatccaaatccgttttcattgatcaactcaaacagttttttcatgatttagattaaaaaagccctttttaggggctttttttggatttattctgattattagctttcgtttgccaacatgtatgctgcagtttcatgcatatcttttaatcctgatctctgagcgtactcggccacagtgatcgcacttgtagtcagaagttctattatatgttcatccattcctgaccaagttcttccgcctgctttttcatacgcatggataagttttgttaatccttctttcccaaacagaagttgatgtgacaaaaagtctgcagatacatcaccaatccccagttcagaccaatcaatcacacccttaacacattgattttcatcaatcagaatgtggccaggatgtaaatctccatgcttcacccccacgaaaggcggccataaagaatcttttgctagccattcttgccagcgctcccataaaccgctgttaatggtgtattgcgatttgacacgttccattcgctgtttcattgattctcttaattcatgagcactgagcatctccacaccgatcgttttaaaaggctgttgatctaaggaatgtacattcgctaaaacgtttcctaatgattcataataagcttgcggtacattcgttgggtcaaaactccacacataagattgctgttccacatcaatactagccgccggtaccccctctaattgtttataagcaatcagactttctgtaaagatagaccaattagggacctgaaagtgaacctgcttactcatatgatctaatgtctttttttcttgtaaagtatgtttctttgattcaggtctgcgaggcattcttaatatccattgatcgccatgtatatcttcgacgtgtgcgacacggaaatccacacctgattcatttattttgatggtactctctaaaatctctaatccgtgatgtttggctaactgctttaattccagtctattcatatccattcctccaattgctcatttagtcatgatcaataggcgtcaagaatatcatcacaaaacccacaaacaggctactttctgtggtcagagtaaacaaagctagacttataattttctttgcatcataaaaaacatacaaaaaaaagacagaacgattaactgcctcttttctagtgaaattgcatactttcccgctgaagatcattaaaaatgtgcagactaccccgtttactccgttttgatgaaaacagagcctttgaacatatgaaattactaattgttcaaagtttgttggcgtaatcttcctgcatgcatcatctttaaccatcctcctctttgtcatataaagttactatactttatttaaatatgactttcaataagatgacaaaataaaggatttaaaaaaaccatatatttcattaaattacataaaatgataattgtgtttattcatgttatgatatggttattaattcttttgtctaataatttatgaaactcaaatgtagctaagtcatttaaagggagaattggtatgactcatttagaattcgcattcggcttgcttccagtcagtatgatcatcgcttcttttatcgtcacattgattgtacaaaagatttatttcatgccagttgtgagctttatcattttactcatcctgacatttacactttttaatgtctctttcttaggctgggtagttgtctacactttaggctcaatcattgcttcatatttagcgttattcatcatgaaaattttaaataaaaagaggtcttaaatacatttaaaaagccctttacaggggcttttcttctttcactatcgtttttccactggataaatgtcttctcccaaaaaagcggtattaggatctccactcttttctaaaaactcagccatttcttgcagctcttgattgatacggttatttcttggcatatccgggtttaacagaaggatggagtgaatcgttgtggctgtttcatacaaaacatgttgatcgtttatctgttggatgcatagtttcatacgattgaaaaaccattcgatctcttctgtttcttccatcggataatgtgccattttgaatagattctgctgacgaaggtcctgcctctcaaatatgtgttcaagctcttctttactgacatataaatcagaatcttcctccttaatctctactacttcgaccatcgcatcttcagctgtatataacttctcaataaaatcatcgaaagtttctgccagcttaaaatctacttccagctctaaatcaaaatagtgaatagaaggatgttccttcgtttctcgataatccatggcgatccatgtatcttcttctccgctgatgatcacaagtccctcaggcagatccaattcattacttaaccgaagactattcatgttgccatcatctttggcgattcctcttaaatggtcaaattgaacatgatcctcagcccatgaattcggctgttcggttggaaaagcattacgaactgtaaacccgccattccattctaaaatgagctttttgtatgtatcaggtaaaatgactccaagtgtaccctctgcttcatgaatttgttcctcatctatcttttttaacgtaaaaggactctcttcctctttctcccagaatgatttcaaagtgggtgcctcctcgtatctattgagataagtataacattgaccaactgttcatttgctcattctacttcataaaaaaacagactcttaaagtctgttttaatcttgtctatacgttttcagaggttgtatttcgatcaatcatagtcgtgtttcgatttgatttttgttcctccattgttgtattccgaattgattttgtttcaatgatttttaaagtttctgctgttgaaacacttaacaatacaatggataaaatgattagtaattttttaataatcatacagacactctcctttttgaatatcattttgagccttaagagcctttctataatattcggtagctttttcaaagtccccttttttttcataaaataacccgacactttgagcaaatgcttccacatagacatgtagtttcttttcttcaaaaatatcaaacacttctttcaaagcttgttcatcagtatccatataaatagcttttaatgctttaaataacaagacacttagcgaatcatttacctttgaggaatatataagtccatcttcaacgagcagatccgcttcatcagtttgattagacttgtacagcgaccaacacaaactaaatagagtgattggctttatgtcacttttttccgaagaaatgacatctaacacttctttataatgctttattgcctctgtatactttgattgcctatcatatgtattaccaatatttaataatgtttttgctactaaacgttgatcgtttgcgcccacagcaattgaataagcagtctttaaatgttgcaacgacttttcatatctcatgaaatcatcataatttcctgctatgacaattagactttgaatttgacgaactctatactgttcatgttctttataaatatctagagcctttatgatgtgatgcatagacacatgcgtttgcttcataatatagtaagcttcagccaccttgaagtgaaactccgcttgctcaatatcatcgacaaccagtgcgagctgcctctcagcgatcttgtaatattgaatggcctgtatgtattctttcttactaaattcatgcattcctctaaaaaaggcattgtaatattgcaacataccggaaagttgatgattagaattctcaattttatcaaccaaatcagaaacagaaggtgatcttttttctgaaggcttgatataatcaagcataagctgatgacgaaagcacatcaattgataataaatgagtaaatcttgatcttcttccatccgttcaatttcttgttctacctcagctttcaaaatctctgcatctggaacgctgaattgccgaatcattttataccattcatttattttcacacctacatgtgaagaaagaactttctccatcccttattccccttccaccaaaatcccttatatgacattcattatcacatacagtaatttacaaagcaccgaaaagaaaccgcaaaaagaacgattgttacatcaataaacctttgacacaattcatgatcatcacaaaacaaaaaggcagactcatttcagtctgccttcatcttctagatttccatgagaacaccttttgtcttcaggtaatttgcaatgaatcatttaaccactcttcacaatgttcaataagccacctcaaatattccacatattgaccgacgtgatagccatcacaaacagcatgatgtacttgaatcgcaacgggcaaaatgattttcccttcttccactttaaatttgcctatcgtaaatattggcagtaaataagcttcatctgtagatacagtaaggttaaaagaagtaaaatcaatccacggtagacttgaaatattgaacatgttttctggcatatgaggtttcggaaataggctgctgcttttgctatatgtttcaatgtcggctacacagcttttataaaactgagcaaagttttcatcataaggcgtccaaatacttgaaaacgtctttgtttctttatttagaattgtataactaggatggagaatctcccagtaaccaagctcatctttcacttgatccatccgaaactcaggaattttttgcacagctcttgctaacaaataaatttgcacaggatatacttttagctttttttcttttaatattgcatgtaatttcgtgatgtctagattgaccaccaagctatatgagcatcgggttaatgtcatataatgatgaaagtgctcttttcgcgggtaattttcgtctatttgttgaaacattttttatctcctcctgaatttgatttactgtattcaggaggaaactttatctgttttcaccaccacaatcatcctttcaaaagatatgtcatgtttctgtctattcaaagtctaccatgagctttgcttacgataaagcctgcagcaactcttcgtaagtcatcttgcccaacgtgaatttttctagtgctatatatgttttctccgctgaggtattcattctattatgacattcattcactagctcatgttcatttggtaatggttcatgtatatgttgtgttcttcgaaatgcttcatagtatcttataccaaatattctttgggacatcgcattgatgtgaattccgtccggattagatataaggcctttcgcagtaacataataacaattttcatgatgttgtgcatatttttgtagttcctcattaatacgttgatattccacacaccctgcgccaaatgctgcctttcccaagaaatcgcccaaacctcctatcaaaagcggaatgttagggacagataattcagttcttagttcatgaaataatcttcgtattttttcatcgtattctttgtatttcccatcttggctgtcactttctccttgatgccataatatcccggccaattcgctatcttcctttgcaaatttagcttcatttattgcatgacgaaataatgccccatctcgtgaccactcatcaatggaactgccaccttcagcacatggaataagaccaattttttctccctcatgatccttacaccaagtctccgcgaaggaagcggccagtcctacaccagcgaccggcctatcaaaatgaataggttcagtcatcatctgccatcttccatttcgcagcatcatgattctttcattataaattggcggcacttcatgcttaaagcctcgacccgccatattagattgtccaattagtaaaaatgacttcatacctttccccctctaaatattttatcaaatatatatctacctgaacgttatcagtttacccttgcgctgtgatttctagaatttcaatcatctcttgaaattcccttaaaatctattacttctttctcgactcataaacataattcaaaccaaaagcaatctcttttaatatatcaatgaaaatgtgaatggccgctcctaggtgtttgtctttcctataaacgatccctacacttctaataagattagcattatttataggaataatctttaatcgaggttcgtttagatattcaagataaggagttggtaagaccgttatccctatgccatctaccaccatattaattaatgactgcatagttgttacttcaaaaatagggtcgggtagaaaaccaatatctttacaacttttgttgattaactgtctgatataaaattgctcaggaaacaaaattgaagcggtttcttctaatacttctaaccccaacttttcactttgtgcaaggggatgtttaacaggtactgcaaaagccatatcttccatgtataaagagattgtttcaaattcatccccttccattggtaaaaagacaattcctaagtccactctattttctattaagtgtttttgaatatccccagtacgcagacctagtacagaaattttaacagctgggtattgctgatgaaatttaaatagtgccggtggaataagatagttctcgactgttagtaatgtcccaattgagatcgatcctctttgaagtccattcaattcattgatcgatatttttgcttgttcaatttcgtgaaaaatattgcgagtatattttaataggagttttcctgattcagtaagagtcgttttcttaccaatacggtcaaacaaaggtgttccaatttcatgctctaaaagtttgatttgctggcttaaagatggttgagatattccaaccttttctgcagcttttgtaaaatgcagttcttgacacattgcataaaaatactctaattgttttaattccattcttcgactcctaattagaaattttcacaagtaccaactttatgatttttaaatatcaacatctaatatacattattatacaaataaaaccataggtacaaactatagttattatataaataattgaattgttctataaaaataagtgtcttagactattacatgaaggctagatttacatgcacaaaggaatccttcaaaccgtgtaaaggaggtcagtcgatataacgagaacaagtaacattttttataaatgataaaaattttaatgttggaggttaaaaaatgaagaatttaaatgtcgcaatcccaaccccctttcatgaagatgaaagtctgtacttggatggatttaaaccaatcgttgaatatttagctgaaaatggtattgattcactactcgtatctgcaactacaggtgaacaaaactcaatgagtattgaagaaaggatacaaattattgatttttttaatcagcaagactttaaacatgttgaactaatgtttggtgtatcagctacaacgacaaaaaatgcattaaaattgattgaaagtctcgatgattcagttttcgactcgattctcattcaatttcctccttatatccgaccaactcaggaacaagcgatgtcttacatgaatgaattgttagagcaaaccacaaaacatgttgttctttataataatcctttgcgcacagggtttgaattgagtgctgactcatttcacactcttatgaatcaaaaacactctcatttggttgggatgaaagaagagagtgatgtaagacgcctgaaaaatacaactttaccagatgactttatcatgttcgctggaggggacgtaaaccttactgaaaaaatattaaacggatgtaacgggctttctagtatggtaggaaatgtttatccaaaagagattcaaacattttttagtgacttagttgcaaataagcctgtgaatcttcaaaaaataaatcaattaatcgatgaggtgacacgtggacacgcgattgtcaatattaaaaaccattacaatgctttaggcataaaggtaggtaggtgtcgttctcccattcgataattattaattcattgcaagcaggttcgaatcatttaatccagcttgccccaattcgttataaaaaatttggaggggtctatagctgccatgagtattccacaaacggagcaaaagaaaagatcgagtatgcagacaaataaaaagatattaactgttgttggtgttattctaattgcagcaaatcttagggccccaattacatcagtcggtccagtattatcttccattcgtgatcatcttggtatctctaacacattagctggtacaatccctacagccattttactcacattcgcattgttttctccttttgcccccaagatcactcgccgtttcagcatggaattcatactgtttatgtcgataacattattattagttggaattggaatacgttcttttggtagagtggacacgttatttataggaaccattataatcggttcttcaatcgcgatttgtaatgttttattacctagcttcattaaacatcattttgcaaccaaattaggttcgatgactggcctatatgctgtttctatgaatttatttggcgctattggttcagggattagcgcccccatttcttcatcattaggtttcggatggtcaggcttcctggggtgctggggaatcttaactcttcttaccatgatattttgggtaccaaaactaaggaacaaccaagaatctttggatttttttcgaaaagagaataagaaaagacctatcagcctttggcgttctaagctagcgtggaatgttacattgtttatggggactcagtccttcgtatttttcacagtcatttcatggatacctgaaattcttgaaactaaagggttaaatgctaatgaaagtggatggatgctatcattgatgcaactttcaatgcttcctgttacatttattgtacctattttagctggacgttttagcaaacaacagatattagtatggatttcatttctcttgcttgttgttggcttaatgggctttttatttggcgtgtcattccttatacccctgtggatgataatgattgggattggcattggaatggcctttagcttagccatgatgttttttagtttacgcaccaaaaatacacaagaagcagcagaattatctggtatggcacagtctttaggttatctattagcagctttagggcctattttattcggctggttacatgacattacttatcaatggactgttcccctgttcatgctaatcttcatttcagtcattattttaattactggtgtgaattctggtaagaacgtatatgttacttctgctacataaatggtaacattcattaagaatctttatgatacttgaatcgtaaagatttcccaattcgtcccttttcaaaaaaaataaaaacaaatatctgttgtcgaaaaaaaaccttgcttagcacgggtttcaacgtttattccgactggactcgaaccagcgacctctcccctgtcaaggtgaaagaccttatccgaagctaccagatgttctcttaaaaagactgatttaataaggtacgatgggcctttctaataaaaaatgtgcacttctgaagaaaactgaaagttgcaaaataaaaatttttttctaaattaatctctcccatcttcgggaaatgaaatataaattctttatgatataattcaatatcagtttaaaaatgcctttttgaactttaacaagcgatccagattacatcacaagaaacttttataaaacgaatttttaggaggtttacattagtggacagttcccccaatgaattgaagcttatcgttccaacaggatgtgacaatgctcccaggaaacaaatagtcattgattttacagtagctatattaacgcagcaaactgaagttattaaggaatatgcggttgaatctattatctggtatcagttaaagggtaatacaaagcttgaagggcgaaatgccttaatctccactttgtacaaagaggacagagaaatcgttggcaaccttgaaatttaccaagtcataacacacggaaaatttgcttcaattaacggtgtaatgttattagcgaatggtttaaaaattgatttctgtgatgtatatatttttagtagtgctgcaaagtctggaaagataaaggaaataaaatcatataggatttaaacattactggtccatttattaggtgactcaaaaggcgttgtgatacaaattccatacgctttttagatataataagtgtaaaaacaccctaacaaaagtaagggtgtcttttagcgaggtatttattatttatagtttttttgtcctccatagcgctccattagctccagcacctacaattacgcttcggcatggccagagttaaaaacaccccctccaattttagagcccaaaatggcttctacataaatccttgttatgtatgttttttattgatgcaaatgctttagatagatatttaacaatatgttagaaagtttacttgttcgatgttacttaatcaacaagcaaaaaaatccccttcctacaatggaaaattcctttaatttttgaaaggaatagtttaattgagaaaaacaaattggtttctgtctatgtttataactgctttaatctcatttgtaattcaatcgggattaagtaagttcgacgtgattaacacgtcaaatctttggctagatttggtcagttggatagtaatattctttgtcgtattcattggcgttgaaacgtcttttagaacgatcaataaaatgaaacattgaaccgaatatagacaaacaaaaaagcccctttagaaagggactttgggtatattaacgtaatagttgaagtacgttttgtggctgttgattcgcttgtgcaagcatagcttgagaagcttgagaaagaatgttgttcttagtgaactcactcatttcttttgccatgtcgacatcgcgaatacgagactcagcagcagttaagttttcagcagatgcccccaagttgttaatagtgtgctctagacggttttgtactgcaccaagttttccacgttgagcagatacttggttaatagctgcatcaacaatacttagttgagtatcaaaaccaacatcagtagcatcagctgcattatcagcaaattttctaacatcgatgtctttcaaagattgatttgcaacaattccatcagcgtctttaactcctaatgcatctgtgctcattttttcaatatgaactgaaatttgttgagttgcgttagcaccaatttggaacaccaaatcattaccagttgctgggactgcaggtgtacctgcatcatctggatcatctggatctcccggaattgctggagttcccggcgttccagctttaaacgtaccatctaataatttcttaccgttaaactctgtacggtttgagataccgtctacttcttcttgtagagctttaatctcatcttgaatagattgaagatcagactctttatcctgtgtaccagtatttccagcttgaacgactagttcacgaacacgttgaaggattgagtgagtttcagtcaatgcaccctcagctgtttggataagagagataccgtcctgtgcgtttttagatgccatttctaatccgcggatttggccacgcattttctcagagattgcaagacctgctgcgtcatctcctgcacggttgattttaagaccagaagaaagcttctccatgttcttttggctcgcaccgttgtttgcagacagacggtttaaagtgttaagtgctgcgatattgtggttaattctcatttcttattacctccgtgtaattttttagagcttatctgtaaagtccatttagatgagaagctcttccttagaattttcgatttctaaggcatgtgtatagtagtaacgcagagcatcttttggttctctaactttactaccttatgtaacatcagttatggcaataatcctgaaacctccttctatcaagcaaaatgattattcttgtcacttttacgagactagatactcgccataacaatgagtattatgttacctactatagacagaccttccacatattttagtttgtggaaattgttaatttcacaaattcgacacatttaacaaccagataaggatgataaaattcaatcaactacagttttatggatcgtatttctgcttggctacatcagaaaattcattatcaataaaagttcaaatgatcattgacagaataacaggactagttttagtaggttttgctgagactattatttacaaatccaaagcattaaattttgactacaagtagagttacaccatttaaaacataaaaaaacctctatcctataaaggacaggggtttttatgttttaatgtcttttgaagagttgttttttaatgtttaaaaaacaaaaaacccttgcttaacaagggtttcaacgatgattccgactggactcgaaccagcaactctcccttgtcaaggtgaataatcatccgaagtaactgatttccccctgaaaaagactgatttaataaagttctatgatgaggctttctgataaaaaatgtgcatttctgaagaaaactgaaagggttcgtccccataaaaaaacagacccttcatgttctgttttaattttgcctatacgttttgagatgttgtgtttcaatcagctgcaatcactgtaagagcaatcaacgtaaaaccctcctttaaagtcatacaaacaatccctctctgagttttgaattgtgtttctaataccttttgatcagcaaccgtagcttcttcaaatcgaccttgtttcccatactcatctgcatatactatctagcatgcttcagcataagcgaaacgctgtttctgctctaaatactgaaagacctcggcaagctgctcctcatttatattattaaaataaatcggtttataccattttaacaagtagaaatatctcatccttattttaatattggcttacgttaaacttgtgaaaaaaacacattcatgtataatacaattgatgtatgatacatgaattgtaggagggtaacctttttgaaaagagaagatgccttaaaactaagatcagatattaagaaaatgattataataactggggtttttgaatctcaaaatttgcccaatggaccatttgaaaaacctctaccaacttctcaaatgatggcgttagaggaactagaggtggaaaaattaactgtttggcaactatccaataaacttagattagagacttcaactgtgagtagattggtagataagttagtaaaaaaggggcttgtttatcgtgaagtaaatgaaaaaaatagaagagaactttttctgcacctcacagaaaaaggtcacacaactgttgaatacttaagagagcaatccattacattttatcaaaatattctcaataacttatcagaatcagaacaaaaaatagttgtggctggttttgaattatttattgattctatttctaagccttttgattagagtgaggtaaatcaaaacatttggagggtataatgagtttggattttgaacgtcctattattgaattaaaagagaaatttgatgaattaaagaaaataatgaaagaacatgatgtagatttatcttcagaaattcatatattagaaaaacgtttaaataaaatgcaagatgaaatttattctaatattacaccttttcaacgagttcaaattgcaaggctacgtaaccggcccacgacattggactacatacctttattgtttacaaactttctagaacttcatggtgatcgattatatggtgatgataaagcaatgataggtggtattgcaaaatttaaagggatgcccgttacgattattggtcatcaaagaggtagaagtacaaaggaaaatatagaaagaaattttggaatggcacatccagaaggttatagaaaagcgctaagacttatgaaacaagctgataaatttaatcgccctattattacatttattgatacaataggcgcctatccagggaaagggtctgaagaacgtggaatttctgaagcgatagctcgaaatctatttgaaatggctacacttaaagtgccaattgtttgtattgtaattggagaggcatcaagtggtggagctcttggcattagtgtcggtaaccatatccatatgttagagtattcatggtactcggtcatttcgccagaaggagcagcatctatcctatggaaggacgctaagtatgctccagaagctgctgaacatatgaaaatttcagcaaaagatttaaaacagttaggaattattgatgaaatcatccctgaaatgaaaggtggagcacaaaatgatataaaatcacaggcacaaatgattgaatctgtgatcgaatcatctctaaaaaaattgacaccattatcctcagaagagcttatacaacagcgatatgaaaagtatagacaaatagaaaatatttaaagtccgtattacatttaggaggattcttacaagatagttctaaatattttgtaagtaacctcttaaactgaatatgctgatactattaaaagatgtgtgatcggtatgaaaaaggatttcttccatcaatactttttctgaaggtcctcaaataattcctcataaaaaacagaccctgcatggtctgttttcattttgcctatatgttttgagattcttcatctctcagtcgccaagccatatctaaagcaaaataagtcaaaatgccatcgcatccggcgcgtttgaacgacattaatgattcttcaattacaacatttgcttcaagccaaccattctgaatagctgccatcaacattgaatcttctccattccttacctaatttccataaaaaacttaatattatatttattatcacatccaagaatttacaacgcaccgaaaagaaactgaaaaaagctcctgtaaaggagccttgtgatagttatagatttaatatgaaacttgtttataaaagtacatcattgaaaattatttataattgtacttaatgctttctttagtacaaccttatcatcctttgacaagttttgaagcgctgtcttgttcagctcaattgttgctgcttcaacttgatctctaatgactaaagatttttgagtagcctctactaaaatatttcttcgattgtttggatctattgtgcgttcaattaagtcagctttttgcattttatctaatattccagaaacggttgaggcttctaaatatacaagttctccaatttgtttaggagatagctggccctctctccatagacagttcaacacaccatattgagcgggtgtcaaatcacattcctctaaaagtttactaaagtacttgaacactttattttgactaacacttagtaaaaaatttatgcactctgataattccattttatctcccccacattgacttcacctataatatcatggtagttttttaattgaaatacttttggaccagaaatattttgttgtaatatatttttagagaggaagatacacgatggattcatttaaagcgattctagttacagaaaaaaatgatcaagttagttatgatcttcaaaatgtaagtgttaatgatttatctgaaggagaagtattaattaaagtagcatattcttcaatcaattataaagatatgctggctgttcaaaaaaatggaggtgtaattcgtaactatccaatgattcctggaattgatctaagtgggactatcgttcatacaacagataatcgtttcgtagagggtcaacaagttattgtcacaggtttcgctatgggcatgagccacactggaggtttttctgaatatgctagagtacctgcgaattggattgttcctttgccaaataacttgactttaaaagaagcaatgatttttggaacagcaggctttaccgcagctctttctatcatggctttacaggaaaatggtatgagtacgaaaaatcaacctaatatactcgttacagggtcaactggtggagttggtagcattgctatacaattattatctaaaattgggtacaacaatatttttgctttagtgcgtaaagataatcaagttgatatagcaaaatctttaggagcagctgatgtcatttttgcaaacgaattaggagagctaaaaaaaccattaaacaagcaaaaatttgacttcgtcttagataccgtaggaggagatgtggcttctgtgatcattcctcaaatttcttatggtggaagcatgagcatgtgcgggaatgcaggtggatttaaattaacaacaactgtgttaccttttattctaagagggatcaaccttctagggatcgattctgtaaatgtaccaatcaataaacgtaaagtaatttggaacgagatagcaaacgaatggaatatctcccaaacgactctagtcaatgagattacgctcgatacgttacctgaaaaaattgaagctattaaaaatggccaacatttaggaagaaccattattaaatattaagataaacgaactttatttatttaaattacaccagacaaatattgaatgtattgatgcagataccccatcccaaacaggtggggtacatctattcaaaaaagagcgggacatgctagtgctaaaataccctcagatatttataatcatgtcacaaacaaattagaatttaacaccgcagaacactttaatcgttttaacctaaaaaaacaacctgcaaaaaacaaaaaacccttgctaggcaagggtttcaacgatgattccgactgggctcgaaccagcgacctctaccctgtcaaggtagatatatgaaatcctgtgattatcaacgataccctcaattcgcttataaaccttgatacataagctttccttacccttctgtatcctcttgtgttctttcgtattttttaaaaaccgaaaaaaatgttaccttttttgttacctttttatacacctgttttaaacttatgattgtatgcaaatttaagcttttccaccttctaaatgaagtacttcttttactgtattttgactccaattttaataaaatccaaagatttttttgaaaatacttcttataaagatgcttaattccgatgtgtaggcagctattagaattggaataataataacacccaatgcccaccaaataatctgtaaaatgtttataaatttattggagttttcaaatcctatgtaccttataatcatttttggaagggttaaaatcgtttcaacccaagctattggattaaacgaactaaacattctttttctatagatgccttttgcttcagagagaattctataaatcgtaaatgctattgctttatctttaattggaaactgctcaattggatctattgtcattgttcgaatatgcccacctccaattggctgttcatgtggaattttaatattctttaatcctgcattttcaattaaagcttttacatctgatttatactcagctaagtttacagtagaacttgaacttgactcttttaaccacctctcataccaattaatgaatttaatacattgtttaaatttagataagttataaataaaattactaaataatacaagaataaagcaaagaacataaaccaatcttaataaacctcccacaacaacctaataaaagaatgatttcattcaaaaaacttttgtctctcttttaatcttctattctcttcctccaattctgcaatgtactcttcatactgttgattttgcgcttgtcttccaccagttattttattaaagatagcgtacatgtatacaaacattactggtactcccattattggcccgaataagatgaataccaaccaaactgcaaatcctccgccaaaaataatcgtatttaaactcatggctacacccctttatcattaggaatattttatcatacggttattcaacactcaccagttttttcatttattttcctctgtttacccctaaatacgagtatgatgaccgtcatagtgttcctattatagcgtgtcggttaggactactccctttaacccaatatcacgcgattttcttccatcattagtcttgacttgtcgtttgctttttggcttgataggttgaaagcaatggacaacggctggacaagttgtctgcctgaatttgcttgtaaaaaataaacaaactcagacaggcgactgactaacttgatagtgtatcaagcttatggtatccgtatatgtcaccctatttgccgttggttattctccaaacaagcctactgtgtcaagtgtccctaacagtttcagaaagcccatatatggactctcctacttgtggcttgtcctgcatcgtcagaaacgatacacccatccttcgtacagcacttcatggcagctttcgcctttcagatacatgtgcaaataggaaagcacagtggtatcctatcctcattttttgcatcggctgagtcactaccctttcaagtttaacgtgtgttagcgcattccacgacagccttacccttaaatttggcatcactaaagacaacaccttgatccaggagcatagactgattctattcagttaagtgaggtaaactttacttacctcacaaaatccacgacctatgtttaaatgaggccgtaatgtgaactattgaatatagattaaaaataagttagaatgggctggtatcatgggatttgtaccaacccatcagattagatagtgcgccaacacttttctaatcagctagaaatgacgatcatgagcagtaggaatatccctattaagctcatgattgttacaaataacaattcatccatgtacctttttaatagcttccccattaaattaaccccactacagctaactcaccactattatccactgcaaataactcatcacggccataaatatcaagcatgttatactcatcatcagcgactccatattgattattgctatgtacttcttcgattgttcctagtccgtataacgtttgtactctttgacctacagatagtttccagtttggattaacattgtttaacatgttcatttcccctttgtaattggtttagttggatcaaggattatgcaatcaaattccgtttcctgattcttcggttctaatatcctcaaatcggttaagacttcccaaagcgtgatttgcttcaatagatgtgtaacgacctcagcaagcgtttctaagtctgcatacggaacatttcttcctatataccagatctttccctcatcgtagttaccatcagttcgttgagtgatttcagctaaaacaatctggccatcacactcccctactgcataaccttctttaacgatgattgctgaataaaggttgttgatttcttgtgtgttgaattccgtttgaacgattgtaatatggttcatttaatcacccctccaacttcgttttgatgttgacttaatcataatccaacttcaaaaagaagtcaactttattttgaagtcattttagagaaaaagccagtttttgattttattttttgttataatcaaaaaggaggtgaaactgttgactaaaattgttaaaacaagattgaaagaaatattagatgaacgtggcttatcaattagaggtttcgccttcggaaatgaccttagcttcgaaactgtcagaaggctttacaataacactgctaaacaataccaacgtgaaacactgggcaacatttgcgaagccttggatataaaaattgaggatttactttacattacagaagatgattctaatgactcttaagcaaaagtattgctttttatttttttgaaatttattaaacaaaacaattgcaatggtgatacaaatagttagaggtaagcaaaatggaagaaaaattattcaaattgattgaacaattggcttcggacgtatcaaccattaaacaagatgtgaaagaaattaaatccacagtcaccaagctggaagaaaatgagcagtattataattggtcagaggtgtagctatatggctgaagccgaacagattttgaaagctattcaagaactttctacacaattaaaagaaattgaattcaatattgttgaattcagtgatgaagtaaagaatgaattcaatcaaataaataaaaaattagatagacaaaatagccacttacattaatgtgtaggtggttttttcatgcgtaaatataccccttttacgctgtaagaaattagtaatacaactaatgaaacaatgacaaaaaacgtgtgaattaactactatttcttctaatttatgtaaaatttatttcattttgtgatatcctcactattgaaaaatgattagaaaggaagtattccaatgaaaaagttttttgttaagatgttgctagttctcatttcagcagcagtatttattccaactacagctacacacgcagcagaaaaggtcgaacagaaagaagatttggtagtaagtatcaaacctactgagcttcagaaacaacttgctttaagagatgtaccattagaaaaacaagaagccttgattcaagcatttaaagctattgagaatgctaacaatgatccacttgctactacaaatggccctaaaagtgcgggtattaaggcagcaatcaaagtaattaaaggtttagtaaataacgactgggcaaaatgggttttatcacaacgttttggaaagcaagctgtaaatggtactgtcaaacacgcaaacaagatcattaaagaattagaaaaaattcttgatactccaaaaaatgcagctggtagggctcgagaggttgtttctgcagagcttagaaaacatatagatggaggtgtagctgatacaatcggacttgttgttgaatacattgttctcactgctgatctactcttactttagataaaaggatggtgactgtatatgtcacaaaatcaattcattcaattccaaaaagccaatggtttagacgatgaagacgttcaattcctcatcactctctcaggagcattttgcagttgtgaagaggaagacaaaaaggcatatgatataacaaggttagcgttcattagacactttggtgaagaattaaacctttcagaaattgaaggtaacactagagaagaatatgaaaagatcatcaatcaatttctaagcaagaaggataaaaaaattaatgtagatgaactcttacaatctttttatgctgcagatatgatggatggattaaaaaagaaattcaattaatggccttcatttgaaggtcttttttaataccatcatttacatatagaccctctcctctattcttcttattattaattttagaaattcaattagaggagttttatcgtggtcaaaactaatagaggaaattggaaggaaatctttgaacatgcaaagaagaatacgacagagacattaacttttccaggtaagccttactcaatagcaatctttcctcaagtatacggtgaccttgttacagaagatcaattctatcaagaattagcaaacataatcataaaagaagcccgtatggaatatgagtttaaagagggtgatgaatattaacgaacacaaaaacaagtcaaaaaagaaaaaggaatcaatcgaaaactataaggttgttacagatttaactgaagaggaaattaaagaatacgttgaagaaataatggagtccgaagaattctataaggtattcgaaagatttatgtacaaatataatctagtctaaaataaacaaaccagtcctttcttgaattactcgaatggactggttatttaatattcaatttaagtacacttccgcacttattaatcaatcaaactaatcgaatgattaatccagcaatggcaataaaagctcctacagtccaaataatttgagcattacgtgctttcgtaactgcaagttctatatctgctttacttgccaagtctttactttcaatcgcggcagttgttatgtttataacttcttctttagaaggcaaatcatcaattttttttgttctttcgataagaatagccacatctttttcgatattgtatactttttcagttaacttttccatatcgtcatcactctccttaccgggggcaaattgtaatgaagtttgtgttagttcgtgtgctattgtatttaattgtactataaaatcgttcatcttactttcaaagtcataaacttttacaaatttattttgacttttttcgacattagatctgtcttgatggactattttcacttttgattgggggtgcttcttgtctacataagaacttaaactaactatattactacgaactccagctcgttcaattaccctcatcattatctttattccccactaaattacttagtacacttatcacttctttgatgctataatcatccatctcaatttctattgattttccatcatttcttgaaaatttcacaacttttttttcatttagtggatcctcagaagacaccacgctaaatagttttagtggctctgttctattaaaataaaattgcattactattactttaattgtcttacaaaaagatatagcgtcttttttataatttttagggatatcatctgcccatttcatacgcttgtcttctaaataaaacccttgaaatcctagcgaaacaaaagaatctcccaatataggttttaaaacttcatccagttcatctatacaatgcggccattcacttctattttgatatgtgttaattattgataacgctttagaaaaaatcattggatcttctttgtatttttcaacactttgtccaaaatactctaatatatcataaccattttcatatgccatgtcttacactcctaatagtttatgtcttaagtctaggaatgtttccacgtaatgtcaataaaattaattttttctaaaccatctcccttctcccaattggtggcaatcgtaagacaaggactatttatttacttcaataatgatgcaagtttcgctctagttttatccccataaattccgtcaggtactaaaccatgcatagactggaatcgtcttaccgcatcagccgttttcactccgtagtatccatcaatgccgttgtttttagcacctttttctgggtaaaaatagagtgcagcaagagcttcttgaatttgctttacagccgttcctttcatcataggtgtacttaccttaaagatacctgcaggaagcgtgtacttagctttagaggatgatttagaaggtgtttttgttggagttgttttaggtggttttgatgctgaagaagtcttacctgtaattgatttcaactctttttcaattgacgctttaaacgaatcccatcgaccttctgcaagaatgcggtgtggacaatacttaccagaccaatcttgatgcttacggattctatcattgccccaaccacgttcttttaaaagttgtgcgataaatttaatggccatcgcttcagcttttttatatttgtctccacctgattttgaatagcagatttctaaaccgattgatgttctattccctgagtttactgcttccccatctcctgtatgtctagctgaacgatcaacaggaataccttgtacaactccgtcaccatctacagcataatgaaatgatactggctggttgttaccgaccatataattaacctcattagctgcaggagcatcattataagtgttatgtactgtgatgtattttgcgttcatagagtaaggtgctttcagtctgtgtttagatgatgctactaagttctttttaattgtaattgccattattaattacctccgtttttatcttcagtgtctttttcgattacttgaagtctatctttaatgaatgaagggattttaacgcccatttgcgctaagttttccagaatggatagcccttcgtttgcgatatagaatagaactgtactaaatactaaagctcctcccaagttcgcaatttgatcgataatgtttgctaagataaccactgcaaaactaaagaactttctaacataaccgaaccaagcattcttcgatctaagatttccttcctttgtagctttgaccactcctgttaagatgtccaccaaagacagtaacaggagcaagtctagatatttaacacctccgaaaaggtatgttgttgcaatttctaggttttctaaatttaaaataatttttattcaatcctttctgtgtttatttcataaaaaataagcctatacctcgtatggctcacctgtgatttcttcatattgttcaggagtaacatagccctcttgaataccctcttgtaattcctcaacggtacagtcattaaaggacatagcttgctttaccattgaagttgtagcccatttataaaacagtgccagcacccagaaattaagattcatttgttgtaaaacctccttttagtttaaggatttctaattgaatttctgccagctgtttccctaatgttgcatttactctttctgactgttgacgagcgattttttctttagctaattgttctccaatgagaagcaattgtttttcaacctgagtcataggctgttcattgtctagtttgaggtactcttgccaagcagactccaactcttcatcagaggggataggctcctctaatgcccaggtgtctatgaattgtccttcaccatcatctctaacagagaaatccttacctagttcagcatctggatataaatatataatcgctagtgccttattcattttttcactcctatctcaaataactcatcgtaacgtaagctgtgtttattgttattgttttgctagtgccctttggcgttatgtagaaagtcactttgtctccagctttaaatttttgtgttaaataaagcacacacgtactcgatgctgtcgttgggttccaatttccaaaacgttgaaattctgttccattcacatagcacgataaaatattatctgatccgactgtaatactattacaagttacataaagcctgattagatatagtccgttattttttagagtaatctcagaacgtgttcgattgtactcggctaggtcgtctgctcgtgttgctccgaaaacaagttttgttgcaacattttcagcagcggaaacggatgaattatcttgatcataggtatcaacaaaagtgctatttgccacatcttctacagttaatacctttttccaccctttaaaatctccattagtatgaacagttccaaaccacatcgtattcttgtagctcgctacagctataatcatttttctacccgatccactttcggacacatcataattaaaccacccagtatcagatggatcaggattgtttaaaagtctgttgttaatcccaaaataaaaccctggcggtaaagtgagtaaatcagaaccttcaggtatcaattttcgtgtccctgaatcttgtgtcaatttgtataattgaccgttgttccatttatccttttcagcttcggttatagcgtcttgatctgtcaaaagacgtttccaaccactccaaatgctattgtttaaatagttggtgtagatgttatttaagtagtccgttgcatatacccatccgaaagaagctttgccgtttgtggaatcagtcatatgaaagaagcctctaaacgaacgattattcggaaggtcttttgaccctgcaattgcatagaacgttccttgacctaatccattattgataacagaatctaagatgcttatggatgtgtctttaagagagagcaatggcatacctgtatctgccgtgatttttttctgctgaaatcctgacacaaagtcttttgacttttgcaaagctgcatctgcttttgcctgtgacccagttgttgtttcttttgcatcccaagacttttgttttgcttctgtgacatgtagctttgaatcctttgcatgttcatctactttagcttgtgcgccttctttagtctcgatcttttctagatcttcaaacttcgcttttaactcctctaaagtttgctttgcttcagaagacattttctctattgcatatttaagtgtctcaaaatcatcaatatagtattctgctaggggtacaatgtcttgatctactaaactttgttcgatattgaatgtaaattcatgaactgacattgtctgaccattgctataaaataaaacaaggacagctttcactgtcccaaattgcttaatctcataatcatcaagaatatattctgctttgccttccactttatcaagaattgtaacttctttcatcctctttgaaccattaatgaagaccattgttaattttccttttaatgcagacaaaggcagcgtctcaccatctttaaaaatctgaaaatctagcttagctgtgcctttatccattgtagaaaaccttattttagtaccagtcaccccttggttataagggtttacagtaaattcaattggtgcttttttgtaaacaggcatgtgttccctcctttaagaaatgttaacaggcgttgtaatcggattgctacttgaatctttataactctctgagtaacctgatccttttacattgtttccatagtgcgtaatattagatgttgtattagtaaagttaattccatgtctcattttcttacctgatactcgaatctctgtgatctttgaatcactcactccagtcatcaaaataagtccatcatattcattatctgatccagaaacagaacgagtcccagcattgataactgtatcgttgttagatacaaaacctttagaatttccagaaacagaaataccagaatatccagtattcacaatggtattatcttttgaagttacatagtcgcaggagccctcttcaaggcgtagaccgttacctttcacatctttaactgtgttattttcaacaataccatagctacttcttgtcacaagaaccccgtgatgccctacgttcttgacagtgttatctttaataatgaagtcattcacatcagatacatgaataccatgcttcaatttaactccatcaattgtatttccaatgatttgaacatcgtcaatagtttgatagccctttctcccaaacacttgaattgcgtgtttttctgtgatgttagtgaaagtattgttattaattttttgcctttttaccttgttgatgcgatttgttggattgccatttgcatcttgtgtgtattgcgaattgattttaggtagaagcgttctaacaccaccataacagttgttaaatgtattcccttctacagctatgtcttgccatttgtttcctgacacagcccattctgtagtatcttcaacagtgttatttttaaagttaatgtgagaatatagatagccgtcagtgcttgtgtgagagtcaattgctcttgcgtagccaccgagctttttagattttctaaacttgcagttttccacattgatttttcgtgtaactgtgttgtcgtatgctccgaaagaaccaaagtttgcagatgatctcattaaatcaacctgaattgcagctgaaaaccatctatctcctttgtaatccacaaacccttcaaatttaatgtcatcaaaatcactttcttctatccctgctagatcaaaagcgtgacccccacatacgttacttacggttatcccagacaccttgatgcctctagcgtgaccaaagccaaagactgagcattgttctttcactctgtctcctgcactatctaattcaccgaaaccatcaatcttaatatttccatgtccattgtacccagtgaacatatcgccactctgtccatttacaaacattgatcctacaaatccatcttctctagctaggtaaaccccatctgaaaatgtaatgcgtgtatctttatagatagtaagcttttctgaaatcgtgtaattgcctggtggaatagcaatccaaattggataaagcaatcccagttgcaatgcttctttcatagccttagtaaaattaccattgtgctttctcaatatttccttgaacggtacagccatccttgcgtcatcaatcttgttatgagttaattgaaaatcatagtccaatctttcatctaacgtggccagtatctttgcatctaaggctactctggatacaatcaactctttaatattgttgccgtcttgttctgttgctaaattcgacattttagctcttaatctattcactaaagcagccaattcaaatccttcgtgagtaatattttttgagctgtgagctttggagctgcttttgtgatcactaataatcctctctaaatcatttaaggctctctcaatagtggccatatcaccctttaacgctgcttgataaacagagtttaaaatcgttgggtattctttttttagtcttaccgtcattccttcactcctttattgagatgtaaagtcagctaaccgaacatcatcaaaatatttttttgtctcaaggatttttttggttgcatttaattgataatcaacaatgcttcttcttgtgttggagaatattagtttggggcttgaataggggtttaaggggttatattgaatttctataagcctaacatcagattcataggttataccgtagccagtatcagctatgatatgtagcgtgtcacctttccaaaactcttcttgaatatctaatagttcttcatcgaaaacattcacataatcaatttcaactgtgatttctgggaatggatttacatgtttcttcaatttagaaagcatagttgatggcttcttaattgtttcatctttcaagggctctccccaacgatactcaccgtctaacaaatatttatcttcatcagggtgaatatataagataggttcaaataaatactcaggttcctttggcttctctttgtctttatcatcagttgatgctgttttattctctttcatagcgccatatccccaagctctagttgtactattttttgttgagaaagaaacgttgatgcctttcatatttactctggaatccaatgtatggtcaattgttttgcccattttcttataaacaattattttgtagttatcaacatctaactctgcttcatagtcttctataatttgagacagtaattcagaagagttcttatcaccaaaattctcttgttcaatttcaggaaacttgctttcactatctttcaaaacgtatgtaaaccttgtatcctttaaagcaatatctaaagcttcttttattttcatttttttagtaattggctttacatcgtcatttcttttgttaataagtaatacaaaaacgtgacttgctttaatagattttgttacagtgccattttcatcttgtttcaggtcaacatcggttatgaaatatttttgatgcttatgtactttctcatcgagatatataacattatcaggaacaagtaaattaaattcagcttggttatcggtagtccttatgagattgaaggtaatatctttcttcccttctgcattatcagtcatatcaatggatgtcccaatgatctcaattaagtcttttccgtctttagaagcaacaaaaatttgattaaaataagtgtctttaggtaggttctcatttttttcagattccgatcccaaatcctctttactcgggaagggtagatcagtatcaggattatcaggaacatcgggatcatctggcacgttagctatatcatcgtattgagtcagattatacgtctcaataatattgatcaatttagaagggtagttgatatctgtagcatatccagcatctttgacagcctgacaagccttcttatagtttttctcaccaacaactgctttgtaccttgataaacgagtgtataaacttcctaaatcttctaagctttgagtatatgatgggtattttctaaactttgcttgaattcgggttacattaccacgcttatcttgttcataagtccacatcaaaacatatttgccattataagttcccttaacaccaaataaattctttgcagacttagctagtccactttcaccaaacccactctctaagcaaccttgagcaataactagactggccaatacattatactttttatataccttttgagcgcctgaagacagatcctttataaaatcttttgctgccattttagccccctatttataataaaatcttgtgttgaaattaatattgaaacttttacaattccttacttcaaactcattccaaccaatatccaatccaggcatccttccagatgttttaagcctttgattgcctacaactagatactgtcgcacattcttaacctcttgattttttttcaattcatcacttatagtgacaatttctccagtggtatgattgatcaacgagatattcttccctgcccctttgaatgaaaccttatagtcatgattaacagtattgatgtaagcatcacccatgttaaagactctaaaaaagttttggttggtgaatgagtattttttatcatcaatcgtttccatgttcattcctatgttccagttctcaccattcaaattcagaattgtagatgaagtatgaattgattctgctaaaccattaatcgctgtaaatacaacattaaagctcgttgcagtacgtctatcagctttaggtatttcataagaatcatcacaggttacaagaaatcttcgattgggcaataaagaggaagatatgtagtatggcttaggtctagttagcaatctataaatttcgtgtctatgttggtaaaagttttcatcgatacctgaatcaaccttaatttgaacagttatttttcgctctttgtaagtaatgtctcttggatgctgcgtttgaacgacaccattcgttctagaaaatgaagtggtctctcgttcaattgatgctgattcaggagtgaattttaatgctttaaaataaggaagcctctcacttaatccgagacttccttcaccatcgttaaaatcaatatttaatatgtctttcatacccctactcttacaccacctttaaatgccttatcttctaacctagcaccactctgtttctctaattttgaagtgtctatatgttttaaagctaattgaccaattgttttgccctctagtgtaataggcgcaggttgaataattatctgttgtccttgtccaactgtatcaacacctaaagcaccagtactgcttaaagctgtgataagctcatttatctttctgtttaaatgaggagtatccacttcgttttttacaactaactcagatttaaaatttaacatttgttgttttgcaccttgaatattcatggacattccttgtaattcatcttttaatgaaccgtgtgcggttttccccattgaagcagcactagctttaactttacccgctgtcttagacattccaatgactaaaccatcaccaaagttaacaccttccgcaattgttttcttggcaggagatttcgagtctattgagcttttaagggatcgaattgctactttaccaattgcccaagcagctttccatatcgttccaccatctccacccatgcttcgaatgccatttgcaaaacccttagaaaaatcagctccagtgttttttgtttttacgctagataaacctttcttaccactgtttgcaacagtcctaccagatgaactagcattgcctgattgaccttttaaacctgtagcaaattgaactcctgcttttgcaccaccgccaccatcagttgttttagatagtaggtttgtaacgctagaactcaaagaactcgctgtagattggttggtaccttttgtagaacttaagcctgcattatgcgctgatccttttcctgccccagcgttccttgcctgaccattgttttttccaagttcgtttaaaacagtttgctgtagaatagaactcgttgaaacagcgcctggccttgtcgatcctaaaccagcattaaatgaattacctttgttaacaccagcttgtctaggaataccgttgttactattaagctgattgtttactgcttgttgaagaattgttcctttttgtgcgctaaacggttcaatggatcctaaaccatcaacaaactcttgcccttgtttttttccagcttcctttgcattggtaggtttgtttaattcctgctcaacagaataaatcaattctgcggcttgttccttagcgtcagctgctgtcattcctgatccttgatagaagtcttctaacgcctgttgagtagctttaagagccttatctttagattggccgaggctttgcaaaaactctatttgcttattcgcccatctctcttgatatcgggtttcattttcctcaatctctgttgctaaacccattgagtttgaagcgaactctctttgcttctcaaaagctttccccgtttctaaatcaagtagcttaccttgatcagacattttcgagaataaagctcttgaattttcttcgtaaacagaggtgttctctgctaatgccgatttataatctgctgtactcttcttcagtaagctcgttctatctttcgattcaatatacccttgtgcatgaagcttattaatcacttcattacggtaattaaaatcttgtttagctgctttctgtccttcttcataaattttctttatgttattgttatactcttgtgcttgtttgaaagacagcttcccttgttgatcagtaacagctttttgcatagcaatggcttctttttgattggctgcaaatttgcttgtagactgttcgaaatagctgaggatattattgtattgttttaactgagaggcgttcattttagaggtatcgagatttgtttcctcttggagttttttgagggctttatatttgttctttgcttctaaaacgtctttatcaatttcaccaatcatcttatcagtgattttttcgccttgtttctttacgtttccatcagtgtcttcatacaaaccctttaaaacaactaaagcatcagttttaagttgctcaagttctttaactaactcgtttctcatttgcgaataagtctcaacgagctgcgaagacattttcttagcttctgagccagatgtacgagttaattcaaagagttgtaattctgctttttctcttaaatcgacataagcttttgcagcttttttcgtaccttctgaaacaccttcgccgtatagaagcatggattctctagctttttcttgctgcttctctaggtttttatgagcttctacagatgcatatatgccaactcctagaacccccaagagagcggttgttccaatgatagctaaacccacaggccccgcaaatgccattaacgctccaattccagccactaaagtcgcagtagcagctgtaacacctagcacaccagctgttaacaaagcggttttacctactatcgcttgtgtaccactgtctaaattattaaacattgaaattagctttgtgcctttatccgcaagctttccaatactagggagtataccgttagcgatattgatttttgccccttctaatgcggaatcaaattcaacgatgcttcctttagcgttatctaacattgtagtggccattttcttagcagcaccatcagattttttcagctctgcagtatttttagctaaagcttttgatcctcgttctaacaggatagcccaatgcttgtaagactctgcaccaacaattgtttttaatgcagctgccttttgttccttcgtcatacctttcataccgatttcaaattctttcactacttcaggcattgatttcatgttgcccgccgcatcaaagaatgagaagcccaatttatcgatttctttttgagctttcttcgctggagttgcaagacgaataagagttgtaccaaatgcttgaccagcaattgatccttgtagacctgcatccccaaatgccattaccgcagctgcagactcttccattccccagcctaatgaattggcgtttggagctaagaacttcatcgcctcacccatttgttcaacattggtgttagcgttggcggcagcatacgcaattacatctgacgcatgtcctgccttgctggcctctaaagaaaaggcttgcatcatgtttgaagaaatgtcagctgcagcgccaagctcaagttgtcctgcagcagctaaatcaagcatacctggcatggcggccataatatcttttgttttgaaaccagccatagctaagaattgttgggcttcagctgcttgtgttgctgtaaatacagttgttgccccaagatccattgactgctgtcttaactgagcaaattcctttgctgttgctcctgaaattgctttaacaccactcatttgcttttcaaatgtcatggctgtatcaattgcatttttaagtggtgcggcaactccagcaaaagcgatacctgttgtaatagcaacagatgaacctatattcctcatcttgttaccagcgttctccattctatctccaagctgattaattcttgaagcgcttcttctagcctgatcttcaaactgtcttaacctttgggttgtttgagttatggagttttgagtcctgttcatagcagcttgtgcattatttaatcttatagacaagttcctagttgtctcagcgatcttttttgtttcctgagcatctttccctttggccttagaagcttgctcatgtgcttgttgtaaagcctttaccctcatcttgttagcttctaaaacattgtttaaatgctttattttcgcttcggattctttaattgagttaccccaagtcccaacagctgttctattcttttcaaactcggatttagattgcttcattatgtttgtggcatctgccatatcttttctaaatctggtgctgtttgcgtataactcaacaccaatacgcctattactcatcttccacctccaatcttaaataaataacggtatttgatcgatatatagtttttcatcttttttaccaggtgcatcacttttagaatttgcaactaatctcgcttgccgttttatatggtagagtaaatccatactatctatttcattttgagaatagccgagttcagctagtgcgttatataaatctaaaactgaatcgactaatgttactttcccatttcctcactaacttcattgtttgaactcaaaagagacaacgcttcatcaattgcacccacaacataaatacaggttgcgtaaacaacatctctcaaatttctagcatcaatgcctttttcaaattgctctacatcaaactggttgtcaaacacttcaaccacaaaggcacagtatttatccaaattaaataccataaagccttcagtttctaattcttctgctgtttcagctgctagtctatagtgttcgccagaaataaatggtttcgttgtaaacttctttttcttgttgttaagttttaactcaatcgttaatggtttcaaaaattattcctcctcttatgaaaaaaggagtgcataaaagcaccccttaagatttatcagttgttgttgttttagaagcttgtgtgaaaacacttccttcaaatacaacatcgttgaaccagttcttcccgttagtaaattcactgtctccatcctcagcggtagccttccatctgttttggccataatcaacaggcataaacttaatagaaatcttaggctttgcatattcttttgatgtttcatcagtcttatgttcagagcccattagagatggaagtccttttaacaaccaagtgtatctatagttttctgagttagattgtttcgctctaaaacctaaagcgatataagctgtttggtcgtttttacttgaaaattgaactccattttctctcttttgattgtaaattttctcttgaagctttagtggtaagtctgctacttcaatttctacatcaatatcacctaagttgtttgtaacatcataagtaccgttgtcggcataaaatgaatctgattcagatttaggatcaattgatacgtttactgcacctggcagcctttctggtttttcgtatttcagactttcatatgtgtcctcagttaggattgcgacatgaaacatatctaatccgtgaattgttttacccaataaatttcctcctaattaaaaaagctcttgcgatatcgcaaggctttgtgatagattttctcttcaatttctggcaagtcttgagagtcatatctgacataccccaattctttaatgcatttatttaatgctttaacaatgagcttttcttttgaaacagtggatgaattacagaacacactgaattgataacgtacttctgaaccttgtgattcattgtcataaaagttatcttctgcgtttttaagttcaaggaatataattctcggatacttggtcgaatcagatgcaattcctctatgaattccaccttcaactaaagtatttaattctttgtccgactttaacttggaggcgatttctgaagctgcatctaagctcatttaatcacccctgttaaaattctttctacagcttgcatagctgcatcaccagcgctgtctgcacttttttcaataaatggatgaggacgcatcttggaagttccgtactctaaaaaacgaacacgataattcaccttcccattgccgcctatcgttacaaacttttcaagcgctttgttttctttagatctagaaacaactatattatccttaatatgaggctgttgcttatcagacacaccgacagtttttctttgttcttcagcaattatttctccaccagttttcaatgcaacatcttctactcgttgaacatcatcagctacacgcattagatcagaaataacttgatcgaatcctgtgatatcgagattagctatttaactcaacctcctcacatagaatttccaatgttctatttttttcttcaacgttgtttatatctaaaatattaaagaccctgtataactgctctccatttagcccttttccattccttaatgtaaaacgcatgtctctagttataaaaggcctatacctaacttcaattctctttggtgactttgctcctaaagcccccgcaatagtcatttcagcatttctcaacatgccatttacagagcccttcagctctgttatgtcttggtattcttcaattgtatttaattcgtcatcttgataggaaacccacctctgaagaatcaaactcttgttgtattttccagcacttttatttttcaaataagtagacctcctcctaactcccgatgctcagttgggtaagaatacttttcaaactgaaatctaaactttttacacttgaatctgtaactggaagtctattttcatagtgatgagacacaaacaggaatagaccaagcttatgcagatcatcatcagtgtctactgtgatcccaagcttagtgaaatgattgacagctgcatttaaaagaagagtgaggagtttatcatccccactccaatcatcttctatagagagatattgcttcacctcttctaacatactatcacctctttttattcagtaggttcagtaggcattggcgtaggggcaggtgtagcagttaaatcaatttgaccatacacataagcttccttatcagcagggataacatcaaaagactcaattaaacgcaatgcaacttggtttttattgaatagtgcatgatccgacatgtctagttgcatttgttcacgttccacaaatgtaactccttctgttgtcgcaccgtaaaaaataggagctttatttttttctgttggaagtgttgcgtttgagaaaacttcaatcactgtcccattaatcatcttttgagttttatttactggattcggttctagaataggtcgcccaaaaccgtctttttcgttatccaaatgctcaaaaccgtcttggtttgtaatgattttcatgccgatttgtaaagtaggatcaagatctttattgatagaagttttaaggtcagaatagcctttgagaacttttggagtcttatctttctttaattcagcaaagattttagtgttttcagtctggatagcctttttgttaaaccactttcctaaatagggtactaaacctccagtttcattctttaaaagttttctagaaacagggaggagagctccgtagtctttaacactataagaaacatttttgaactgaggtttatcactatcaggaattgtttcaccatcagtaaagttctctaattcaacaatttttccattgctttcatacacaaaagaaccttcaagcgtagttgtaggataattgtttactaggtctttcgcagatttatattcacgtctaagttcagtaatttgagtgtgaatatcctttggcactaagtaatttgcactatcatcaccacctgtgagcaatgcattctcagcatctgtaagtgattcacctctaattactttgtgaaatgctttcatctcatcaactttttcatttttatcattaaatttatcttcgaatgccaaatcttctttgtcatcagcaagtaatgcagactgaatctcaaattctttacgcagattttcaatttcatcacttacttctttagctttatctaagtttttctgctctagtaagcttttagcctcagcctttttgttgttgatttgcttcaatagttctctaagttctttattcattatttttcctcctatatttgagcttaaataattgatagctcaattaacatttgattgattttattttgttgggattgttcgttctttgtttctttgggttgattttggggttttgtaaattgttgaggtattttactgtagtttttgaaataatcagaggtacaagcgaccatttcattttcttgggatacttcgacattgaagtattttgaagcttcaaagccattcaaccaagtttcatcattgaccatttgcttaatagtgttgatatcaaccccctcttttaaattctctgcatacacgttaagaattccttgctcaatttgatcaaggtcatcagcagtttttctcatatcatcagaattgcctacaataccactccacggtttgtggatcattagaaaggcgtttgaagggatcactattttatcccctgccatagcaataacagatgcgattgatccagctaaaccatccacatgaactgttttaaaagcattgtttcttttcaacatgttgtaaattgcaagtcctgcaaatacagagccacctccgctattgacgtaaatatttagattctttacgccttctacttgtgttaaaaagtctctgacatcttcaggacatgtgtcagaatcttcccatttaccccattcagaactaactatatctccatagaaatacacatccgctgattgttcagattggtttttaatctgtaagaatttattcgctatttgaatcacctccttttaaagcatttgatttacctaattggtagtcatctgcaatatcgatagaaactgaatttaaactaaccctatgggagttgcctgattcacctattccattcatatcttctagatttagtacatcattgatgctcaaagccccaatgtcagtcatggttttataataatttgaacgtgattcatcatcgcttcttagcgaacttctaatattaaacttcacataatggtcagagtcgctgtcagtgaataacttataattcaattcctcttcaatggccactaattcaggctgtatcgtgttagaaacaaactccatagactggtgttcaatgttattaaacgtgctcttatcaagttcagaaagcatatgtaatggaacgttaaatatcctggcaatttcagcgatattaaatttttgagttgcaatatactcagcatcaactaggttcatcgacaacggttgataatcaaacttcccatctaaaacggcaactttgttaaaattatccagaccagagttagcttcctcccacgcctgtctaactttctctttagcctctcctgagagtatttcttcgcttttcaaaatccctttggtagtagttccatttttatagaaagaccccacatatttctgtgccgccttcatagtcccagcagtttctcttgcgatggttactggagacttgccaactattccatcaatagataaataaggaatgtgcaatatttcttctgagtgaaatttcttaatatccccattcttaccttgatataaataccatatatcctcattaacatcttcaatgattctaatcctattaggttcaagaatcttcaactctttcggatatccattttttccagtcacaattctcacataagcattcccccacaaatttctgtggactgttattgtgtgcttaaatacatatggtgtttggagtgagtttggtcgtttttctaaaagcttaacaacaggatggtctatagctctctgtctcccattctcggtttttcggaacacttgtaacggcaacttcgctgtgtgtcgagccttaatatcaacagcagcaaagatagcacctatgttaagtgaattttctggtgtaatgacttcaccactacttgaaatacttaaagaagagaacgctcctaacccattccaatttgttgcgctgtttttaaaaatcttatctaagattatgatctttcacctcctttccacagcagaacaccccaagaaataaggattccacctagtaaataattaccgaaattaaggctgatcccataagatgttagaatgattaggagtaatcctgataacagaaaaaagtcgccccatgttagtttcacgactcctttaaaactgttgaacttattcatgatgttgcctaaaatagttttcaaaatacacctcctaaaaactaaaatcatctttcagtacgtgtttatctaagctgttgctatattcatgcagcatagctcctgtgtgtgcattcataagagcagcgacactatctattttttcttttgatctcttctttgaaagcttgtatgcatattcatcgccttcggttacagcattggacatggagtatgttaataaagggttattatcatgaatcactttattttggaaaacgaggtgtttgaagtttttggttgctggggaaagagactgcaatctttgaggagtttctattacagtgtagccttcttcttcaagtaaaatttttaagtggcttgcatcccatgcgtcataatgtatctgtttcactttccagtcttctttttttactttatcagttatccatttcacaatatcccgatagtcgtttactgatcctggagttctagtaatccatccctctctttcccatagatcataaggggctttttcattctttattttatagtgcatcatttcatctggaacgaaagaatgactttgaatcgcaaacctcccatcatgaagaggatgaattgtagacactgagcagttatcgtcagttttcgccaaatcaattccgacatagcactcagaaccttttaaatctgggaattcatctttatctaatcccatccctttccacttttcaatcggcatgtaagagttgtcgtgttttgaatctaaccacatattcatagattttattaagtagtcttttaaatcatcgccctgtttttcttttgcctcttcagaaaaatcgattaacttttcaagtgaatccttgtcttctgctgctaaagggttcgatttaacaaagtttttaacatcgaaaggatcatcgtttttatctaattgtgctatataaacaaaatacttctcattttttactgcaccttttaaaatcttctcgcagtaatcttgttcgactttacaagcggaagttggatcatccccagctgtacttataatagatatcaagctttgtttttgtgttacagttcccttttcaagaagcttaaccatctgattgtctttgtgcgcatggtactcatcgatgataccgcagtgaggattaaatccatctattgtgcctgtatctttaccaagagcaacaatagtacctccgttaattctacatactatttcactagcatgttcacgtattttgaacatttttaacaaatctttatcttcttttatgaactttgcagtctctccccaacatatcttcgcctgatttcttatagttgcagtcatatatgtttgagctccagcataattatcaaagccagtcatatataggcctatgccgctattcaaaagtgatttagaatttttcctagcaagtaaattgaaactcttgttaaaccttctgtagccactttccatatgtatccaaccaaatacagatcctaaaataaaacactgaaacaactttaacttgatcagttttccttttgtgtctgattctccactggtgaatttaagcttctcgaagaatttgagcaccctattggctttatcctcatcaaaaacataaggaaaatcttcagttccttgcctttgtaagtcatccatgtgtcttttacaagataatttaacgagttcgccagctacaatttcaccatttaaaacttttgtagcgtattcagtcactctattcattttatataaactcactaaatttattttcttctattcttgtttcaggaactaccaatttcaaacgagaatttatggtcaaccctaactctgtagactgctttctaattaattcggcatatttggtctggacttgcacatgagggctaacaactgtatttgtgtttcctgtggcattcgtatgttctacagtcgttccatgctcctgaattgctttagaggctttaaggtaattagagtaagcatcacaatacacagccagtgccacagtgtctaaatttgtaactaattctaactcaactaaatcttttatgactcttttccattccttttttgcatctttatcgagccaattcggacatttgattttgtcatttttgggttttagcttactctcgatttcttctctttcagcaatctctgccttagttaaatgcgttttaccttctgcttttattacagaaatcggcttgcttgatctacctgccaatttaccacctccttacaaattcaaaagggaaggtttaaaaaaggaaattcaccgtaggttggggggagtggggtctacagattgttcttttatagagattttagtacggggggtactttcctctactctagatatgctttctgccaacacgtacatacacctaacaatatctttattaaaatgcttctgcttcatttgaggcattgaactatcattcatacgatcaagtatttcgcccaatctttccttagcaagcaaagtatcacttgattctttagtttccactacatcctcttccttcttacgatctccctcaatctgttccttaccctttcccatacctcaactcatcctctctggtctttttattgtggcattcatgacatagcatctgtaggttgtcatagtctaatcgtttactccaatcaatcataataggaacgatatggtcacacacatcagccacgttaagtttcttattctctaagcagaattcacacagattgtttttatctcgcttccttctatcacgaacactcttccactttgtagagttatagaactgttttgatttcttatttcttttatgttgatcatagaatcttctattgacttgagactcatcagcaatctctttatgttcttcacaatacttatctttcgtaaagttaggacacattacctttgcacatagttttagagatcctttcataactattcctcaaactttaatctcaactcatggacacgcaacatgtttgcatcttcaagcgctttgatctttttctggtagtgtttgatctccataacattctttctaacaaacttatcattgtagaagtatctgtactcctcttgacaatgatcacacttgaagtaactcacattagtttcgttgtcgagtttcctttccttaatcgaactgataacaaagtgttttccacatttgtcacataagattcctttgtcgctactcattgtcttccctccaataaaaataaaaaaagcatccaacaggacgcttcagtttgcttcaattactattccagttatcatcttgctgccatcttgtgctttgtcaacacttccatagacagtaatatcatcgcctggtttgtatgtatctgtagttagattaaatacagtaaacgttcccgtttcatttgaaagcattagataatcaagcggactcccgtctttagctacagttacgatatcccctgacactttaacttgatcatcaatggacgattcttcttttaattggtctgcggatatctcttgcgcattttcaaccaggttgcttttattctcttcaacggacgcttcgtcattcgcctctgcttcgaatgaaccttcttcagatgatactgtggtttcttccttaacattctctttatttgattcactctgttcttttgtacccgaacaagcagcaagcgtcataagaatcagaatagctataaacactttcatataatcccctcccaagaagattataccattattcaactaattcaattaagcttactgaatctcttgatacggtgcctttatcatgtttgatcgtttctttaaaaaatgctccaaaatcatttgtatgtaaccgttgaatctcaaaattgattggcttattatcctcttcatcagtattccactcaaagtgaattatcactctatttgtaatttcttcacctttgtagaatacttcaggtattccatcttcttcatgcaatttgatttcaattaacgctggattctcagtcatcgctcgtctcctctatataacatattccgtacatttgcagcagtctcattataagtcttgcctaataattccttgccgaatttaataacaccttctggaacttcctcacctgcatagtaatcaatttcataactactaatcactgttccgtaagtttcgccaccacgataaagtgtatcaactattggtcttacattcccaaagacaatatctccattattatcattgtgctttttatgtaggttttcaaagtaagcttcagtcttctttgattcactcatgaataaattatcatctttgtctttctttaaaaaatccgaaaacatcaaatctaatgtatctcccacttttacttgttcttcaatcacatcattcatttgttttcctccaatttaaaaaagagagcatcatagacactctctccattattcttatgtattttttagggatatgtatttgaagttgttaacgaagtgctttcctaattcagaaggcgttctgtagagttataatggtattgtgggttgtttactcttcttcctttgacgcaaacaccttatcattcagaagaatagctttactcgcatgaaaccaagttgagcccatacatcttccacattccatgtcttcgtctttgaaatagagatcacactttgtacaatatatacctgagtctaatagcttcttcctcatcctacaagcatctctttcttcagtttcttgatgaaataaacttgccctttgcctgtaatacgtggagtgaaactgattctttcaaacgtaccaggtaagtatccagcactctctgcaaacgcaatactctctcttgcatcaatcacacctaaatccaaactcttttgagaaggtctattccaatcctgagttaatagatatccttcccgtctaagccaagctgcgaacttatttcttcccaaaggaataccagcgttcttcaactgagtcgcaaattcccctagactaatagttgctgaagaaatttctattgatacagcaaactcaacctttggagcttgttcttctaataatcgttcgttatatttattcttttcttgttcactcttcaattgagtggccaatctaatgatgaaatcaggattagttaaagtttcttctacagtttgcggagttaaatatccaccgtgcttatgaatagtaggaatgacttcatgagtgatccagcgtttaaattttttcgcttctggttttctgctacttagaactagagaatataaaccatactcatttataatgttggtttcaccagataagccccctaagttgaacttagccacctcgtcataatctaatcgaccaattgccactgttgggttactcaattctagaatctcgcacacgtctttcgctacaaaccatacctcttcattctttacaactgttcttacttgttgatcttcataattaaaaatttgttccattgaaatacctccgattatttgatttgtgcaagcagaaaaagcccttcgaccatttaaggcgggctttatctcttacatcaactcatctaagctattggaggctaaattgtttgccaagcgtatatcctattgaacatacggtacgatagagcgtctcacctctatcccattccctgttactctttttaattattaacagtttaaaaaaataatgttataaccttcataggggagatatactaaccttttaatttggatatttgctttttacctcccttatgacgattatctccaaaagcggtctaaacccttgtggctgtagggctgtagccactttttaacagagtttattttgcacaaaaacgctgtatcccttgtggctctaaggctcaaggcactttctattttaggacaaacgctgttttttcttgttttctctccacgcatctcttagtttaacttgagagcaaggtttacagtactttgttttattagagtttgatttaaccattattccacaacttaaacaaggtttgttcacttttagattgttttggagattagatagaatcacatccccaaaacattcccacagcgtagctttatatctgcttttctttttatatagatgttttacaagaacatctaccacatactgttcatcactatttatttcaagtagcttatctctaatgagtttgtaaacgtacaatttctgatttggcttagtttcttcattgttagtaagccattttttgttcccttaaggcgattatctctaaaagtggtttgagaccttggtacgattggcttaaacatgtttttttcatagtaattttttgcacaaaaacgccagactctttgggagagtaaggctcaaggtactttctaaaccgtcatttttttcctatgaggggtttggggtggtgtaggacgaaagggcaattcaacttgttgaagtgaccaaaagtcagcaccccaagatcttattcagaatagattattatatctatatttgttattttatttttatacctttttcttaagagcaacacccattttagccagtaataccaacggttttcaaattgattatttaagaggtttattctattaaacattcagataactgttccacaatacattcactttgattttattttgtcggtctttttgttttatcttcaagacattatcaaatccataacatgggggatgctttagatagataattttccactgcgttccaaattatctatcgtgcagccaaccatcccccatacccccttcagactgtatatgggattttattttcccttctaaaaaaataatctcaattatgctgattcgctatatttagaataatactagaaaaattcgaccaacaaaggtaagtataattatttggataaggacgtttactggtcgaattttatcaactgaaaattagagctatttcctcattggtcttctcatcaagcgcgctaacgtctatttcccttaactcttctgaaatagattcagcatcatgtttaattaaaatatctatcaatttattaatatcatctatgtattttgactgattcctatatacgttttgagatgaatcaatatgacgtttttttgcgttttgtagtaatctagcacacgctttaatattaatctcttgaatatacttaatgcgagttgcctctttcaaaagcaattccaacatactaatacattcatcttctatgtgcttactgttgagaataatttcgtatacttggaaataggaactgatgttattatataaatataactctttattaacttttgattcgaaatctctccacacctttttcccttttgctctaatttgcgagagcttagtacacccaaattcttgcaatattttcttttgactaaccagaattgcttctgtttctttcgctgttgctactctagaactttgaccattttcgttcactttataaacagttgtgaaatgtatcatgcttctatccgaaaggctatctaaagcagctttgatagtttttttgaagctgccttgacatgtattataaaaatcttgtactacttcactgtcagagccaattaataaagcaatttcgctttttttatgcatagtactaaaataatttttattaacaaatccaagagaactaattaatttactttttgtaatatgaagaagtttatttcttctatattcctgtgctagcatatctaacaaaagccattcaattaattgaatatacacggcatttttagtgtttttttctttcggtaaaggaattgtataacgtgatttaataacaattgtatgccctcgcttttcatattcacagtatcgggctaactcttttaattgagactttttgctattcgtagaatttttataaaccaaacccgtttttgcacacaaatctttatgatttttaaaaattgctcctggttcaagaacttcaatttttataacaatctctccccttattcgatgatagattttttagttttttcaaatttgaatcaagatgcttaagcacatgtatttgatcattaaaaaaattgatttcctttggtgaaatcgttttaagaactttatattgatatgaatccaattcagcagagtcaccaatgtcatctttaataattacatgtttgacgttcttaacttttataactttataaacactatcaaatctaagattatttaggactcgaaatctattgctgaaacatttatccatatgtttttctctattatcaactggaagtatccaatcaccctctaacggccatctgtctatagctctaaaatattgtttttcaccattatcttgaataacttcaacaatctccattgaagagaacctactttctttaaatttggtaattacagtataacatttccatatcaattaatgtctcaatgtaatcattatctaaaatccttcgatgatgcaccttcaccttgatcagataacatacgaggacacttatcatattgcctatcaatgtattttgaagcttccctaatacgtttctttttgtctgattcaacagatttttcattgtcgtttagtttcatttgattctccttttgtttaagatcaaattagcgcacgtgcgctaaatatatcaaaaaggcagggatccaactccctacccttccaatatgtatcgatttatgctccacgccccattcctgcagtatgataatcagctgcagtttgaaccgattgctgtccacctacaaaagatacgaccagtgttgccgcaataacaattccaaataatacttttttcttcatatattcacctcccttcaagttatatttcatttaaatagctaataactctaaaattctctcgctctccccttggcgttctaattcatgcaaaggaagctttatgcaatatttatctcctgcctttttaaaatattcaattgaatcataaagataacccttttcattgaatgctagtgctttgagataaaaatgataacctagatacgaatcatgttgatccattccctctagttctaaaagtatttgctgtgctctaatcatttctcctttattgattaagctaaaagcctcttcttggatatctaatatgttgtctgcatttttaatgacccagggattatcttttccccaaacattttctacaaagcaaaggctgctgataatgtcatcataaaaaatgtctcccttgttgcttctttctaaccccttaagtaagttttccttcgctatgtcataatcttcgaagatatagctattaccaatgttcaaatatgcgtaaacaacaaatcttctaatctttgtttctgcaagagcataaccagcatacattcggcatttctttgtgttgtttctattgagggcgttgttagctaacagaattaacatacgacatctataagaatctctgaagtaggtgtctgctttaagtgcatccaagtctatctcaccgataatctcatccaaaagatcaaaacgaccaagatttaagtacgtgtaaagaagcatcaacctggagaagactttcatttccattgagataatgtctaacttcgctgtcttcttaattgcattaactgtgcttaactctccatttgttaattctctatgtatagtatagacttgagcacattctttattaatacaattcgatgatttcgacaggagcgatataagggcatctgtaagcctgtgatactgattcacgtccgcatactctaatatatctcttgcccaatttgcatcaatgtccagcctttcagataccttcttgatcgtactgggcgcttccttttgccaactttcttctattaactttatgattgaatcaaaaccctcagaaacaactgttttcatagtaaacccccgaatttatttaattagaatagtctggatcaaacatttttatttcggtgtcgatttcttgttgagctaaaaaatttagttctggtgtgtttctgtaatttttaagaaattgaacgtaagcatcaggattattaaaaacaaactctgatctcataataagatttgcctgctcctgtctgtcactcacactcgattgaacggattctagatgttcaagtaaagctgacattcgttaaccccctttaattgtataagggggaagtcccccccctctcttatacagcttctctatttgctaatagatcagcaatgaagtctgcgcctttcggtgtaacaagtgtgattgttttaattccgatattggtttcctgtgttttcacctgaaagaatcctcggtctacatatttctgataaggaacgtttttgtttgtcccactcattaaaatattgttttctcttaaatatttgaaaaggttattctgccccattcctttaatacaaagtactttagctagttgtccaattttcattaacccgtctgcatctaagaattgattgtatttctctaccttaggctctgccaatgacaactgcgcttgtaattcacgcttcgcctttctttcagtgaagtaagcaattgctcgttcttcctcatccagcccaagataagtgtcaattaatgaaggtctagcttttaacgccttctccatttcttcaaatcttgaaacatattgagctgtgaacaatacaccttttgttccagtcattttgttagcaaccatatcgcagcctttacgagtaaggaagaaacatttataaggttttcctgttcctgattcataacaactttcaatgaagaattggtcagcccccaaatttgggttttgacttaaaatattgatatacccattaatatccctcactagatgatcatgtctctttccagtcatctcagccacttctctgctatctaccaaaagctgtccattctgttcaattaccgttaatttattttccaatataattcctccaatttgtttagattttttgcttccaactatattgtccgcaaaagtaaacgttttgttatagttggctttcgtaagacactcgtaagacagttatgtaaaaaagtttatttaattttcaaagatcgtatgtggctttattgttctaagtggagttggagtagtgccagtctatttttctattaaatatgtagaaactgttcatttggatcactccgattatgttatagggtgttgcttatgtatgtattcgttattctgatactccgttaaaccagttgaaaaatgcttttgctggaatacggtatactgtgccaatcttatgcgctgggaaaaatccttttttaacaagatcgtatgcctgtctcttaccaatgcccataaaattctggatgtctttcacttcaagtaccggtttctcaagaattgccgtcaacaaattccctccttttctttttgaactcccctcgtatcctctgggtgtaatcttatagtaacatgataaatatgataacacaatatatttatcataaatataataacaatattatttttatcatcaaaatgatgaaaatatgataattttcgtataattaataagttattgtttttatgatatactcaaaaacagaggtgttaaaaatgacaacgattgaatctttattaaggaactctccatatttcagagtatttttcaaatcatatcgaaaggaaatgggagtcaacgctagagatctatccagagaattaggtaagggagatgcttatataagccaaatagaaagtggtcgaattaagaacattgatgagagcactgcaaggtggctgttaaacaaaattgggacaacccaagaagaggttgataagattgtatacttttatttctacagagaacccagtcattataataatgaagcattgcatcatcgcagagaatcctttagcgaagaactaaataccgatccagcatccaatgatctatataaaagcttgtttgaattggtggatagtatgaggccacaagccactgacgaagatttgaaaagaggagctgaaattttaggaagagtaaattctataaactcaaccataaagatattgatagctgctgatttagaggctgctgacgatttggtgtcaaaactttccgaactgacagctgaagtaagtttccctatattcaacagaaaatctgaagaacatcaaaaaatagcaggggtattattagatgcgaaaaacgtattagaaagcgcagctcttaaaacccaagagaaagaagaacctgaccagagcgagtaatatttatgtaagcaaaggaaagtgatcgggagacacgtaaggaggatactatggcttctatacattcatatgaaaaacaaggaaaagaacattactatgtcatgtacgacatttatgtgaatggtaagcgcaaacagaagaagaaaaaaggcttcaaaaaaaagaaagaggcaaaagagtttaaatcaaaagtagagaatgaaattaacgaaggaacttacattgatccagcaaagatccctttttctgagcttgctgaaaagtggttcaataagaaaaaaataggcttatcaaaacagactattaagaactacagaattaacctggataaatacgcgtttcctttttttggtgatgttgcaatatcaaagattaccacagaggatattgacaattttataggtgacatgcttacaagaaaaaccaaaaaggggaaaataggctatgcaccagaaacaatagataaagcttttgatgttattagtggatgttttaattatgcgattgatcatgaattaattaaaaagaacccctgtgacaaagcaactctccctaagatgaaaaaaggtgagacaagtgtttggactgatgatgaggccaagactttcctgaatagcgttaaaaataataggctatactgtttgttttatatagctttacacactggtatgagacaaggagagcttttagggctgcgttggaaggatattgactttaaacacaaacgcttatcagtcaaacaagtaatgtcgcatgatgctagagagatgtatcttggggctaaaaccgaagcgggtaatagaagtatcgatttaggcaataaagcccttgaagtattaaaagaacatagagcgaaacaagaagaagaaaaagtaaagtacgctgacatatacaatgatcaggatttggtattctgcacattacatggaacaccaatgaatccatctaacataagaaacagaataatgatccctgcaatagaggaaacgggcattactaaaataagatttcatgatctgagacacacatgtgcaacgatattacttttgaatggcgcacctgttaaagcagttagcgagagattagggcatagcaatataaaagtaacacttcaaacttatgctcatgtactaccttcaacaagtcaacaaatagctgatcaaattgatggaattttagattgaccacactgaaagtatagtgtggtttttattttggtaatgttacctttttgttacctttttgttttaagaaatacaaaagccactctcgattatctcaagaatggctctgtatcaacgtcttttcatatgattccgactgggctcgaaccagcgacctctaccctgtcaaggtagcgctctcccagctgagctacggaatcgggttatgtatcagttctgggctttctgttactgacagtctctattatataaccatcatcataagtcgtcaatggttttgttcaaaaaaggtcaaaaagccggcggccgtgccggctttttttctcctttatgattggttgacaagaactggctttagttgatcaagtgcttgtttgaagtcgtgtttgaggtcttcgccgttttcaactcctacacttaatcgaagcaggccatctgtaatccctcttttttctctttcttcctttggcatagcggcatgtgacattttggctgggtatgacagaatggattcgacggcgccaaggctgacggcgaatacaggtaatgtgacagcgtccaccaattctttgacagccgcttggttttctagttcaaatgagagaacggctcctgctccgcttgcctgctttcgctgaatatctgcacccggatggtcatctaagcctgggtagtatacttttttcaccgcaggatgttctttgaggaatgtagcgagttcatatgccgtttggcttgctttttccaatctcacttgaagggtttttaatcctcttaatacgagccagcaatcctgcacgcctagcaccgccccgaaggagttttgcagtgaatagagttcctctcccagcttctcatctttcaccacagctaagcccgacagcacatcactgtggccgcttaaaaatttcgttgcactgtgcagaacaacgtcaacaccaaggtccagcggacgctgaagcgcaggtgttaaaaacgtattatctaagaaagtcagacagtcatgctctttcgcaagctgtacgacaccttcaatatctgtaatgcctagtgttggatttgacggtgtttccatgtaaatgacctttgtattcgattgaatgcctcttttaacttcattcaaatccgtcatgtccacgaaggtatgctcaattccaaaccttgaaagaacttgggtgatcattcggaaagtcccgccgtacacatctcttgtgacaaggacgtgatctccttttgataatagaagaaaagcagtggagatggctgccatgcctgatgcaaaggcaagccctctcgttcctccttccagcgccgcaatcgtatcctctaatgcttgccgtgtaggagttcccgatcttgagtagtcatattggccaaattcatcgaagctgctttgatgaaatgtggatgcatgctgaatcggtacactgactgcccctgttgaacggtctgttttaaacgtattatgaacgagttgtgtttcgaatgtccaattgtgtgtggtcatttggcgtgtacctcctcttttacttgtgatagtgcctgtttcaggtctgctttcaggtcatctacatgctcgatgccaacagagaaacggagcagcttgttacacacaccgtttgcaatgcgaatctcttctggaatatccatgtgcgtttgcgttgcaggatacgtaatgaagctttcgactccgccaagactttcagcaaaacaaatcgtttttagttgcttcaaaaatggattgacccagtcctctttagctactcggaaagacagcatgcctccctttcctgggtaaaggacatcttgaatttctggctgtttctttaaaaacgctgctagctccttcgcatttgcctcgtgctggcgcattctaagagccagtgttttcatccctctcattaacatccatgagtcaaatggagataaaacggcgccaattgcgttttgatgctggaacatgtcttcagagagcttctctccttttgtcaccacaagcccggcgagaacgtcattgtgcccgcctagatatttggttgcactatggatgacaatgtctgctccaagcgtaatcggcttttgcaaaacgggtgtgtaaaaggtgttatcaacaatgaccaatgcgtcatgttcttttgcaaccttcactattttttgaatatccgcttcctgcatcagtggatttgtcggcgtctcaataaagactgcttttgtgtttggcgtgattttagagcgtaaacagtcttcatctgaaaaatcatcgtaaagaaaacgtaagccatactttttccattcgttttcaaacaaacggtatgtaccgccatataggtctgatgagacgatgagttcatcaccgctttcaaatagcgccatgattgtttggatcgcagccattcccgaactgaaggcaaatccggcggtcccttcttcgagtgaagcaatcgcatcctctacaagctgccttgttgggtttttcgttcgaatgtaatcaaatccggttgattcccctatacctctatgtctgtatgctgttgaaagataaacggggggactgaccgtaccagtcgcctcttcgctccggtttccaatttgcgctaatgtcgtttccacatgttctgtcatttgacaccatcctaagtaaaaatctgatttcaaaacagaaaaaccccttcttcataagaagaaggggttttaatcgcttcctcttatcttccaagcaaaaaagctgcttgctggatttagcaccttggtacatcacatgaagtgatgcataccggttgctgaggtttcaaagggccagtccctccacctctcacgataagaatgtgttgtctgtctgttctaattcttaatactgtaacgcattaaatctcatttttcaagaggaaatggaacaattaattgaaattttctgtattttataacagattcggtgttaactgaattgattgcatgttagcatataggaacaacgctatttttcatgttacaatgaatggaaacgtttcactttgtgatgaaatcggttagctggaggaatggattatggtgaagaaaacaggcattattcaagaagaaaccttacattcaaaagaacttggggcggatatgacccttttgatctatttgccagtcaattactcccccctttatacatatcatgtcatcattgcccaagatggtcatgattatttccgtttaggcaaaataggcagacaggcagaagaattgatgcaaaacaaagaaatggaacgctccattatcattggtgtcccttatgaaaatgtcacggaaagacggaatacgtatcatccagatggcacaaaatttgaagcatataaacgctttttagcaaatgaacttgtcccttatattgatacgcactatccgacctatcaaattggctcaggacgcacgtttattggtgattcactgggtgctacaatttctcttatgacagcgatagattatccttctttatttggcggactcattttgcagtccccttacgttgatgagtcagtcttagaagctgttaaacagtcgactgccctttctcattatgcgattatccatcaaattggactggaagaaacggctgtgaaaacgacagacggccaagtgcttgattttattcagccgaacgacgatttaaagacacttcttgaacagtcaggtgcagattatttatttgagacattcgaaggggatcataaatggacgtattggcagcctcttattgcgccttcgttaaaaagaatgctcccatattcgttaatcaactgaattttgttataataaacaataataaatactttcttaatcaggagggaacaagatgaaatacggagttgttatatttccatcaaaaaaattgcaagatattgcgaactcttaccggaagcgttatgatccgaactacgcactcataccgcctcatttaacacttagaacaccttttgaattaacggatctagaagcggctgaggtcgtctcaacgctaagagagtatgcaaaaaatgcttctcctgttacattacgtattaaaaaattcagttcattcgctcctgtaaacaacgttatttatatgaaagtagaaccgaacgaagaaatcatggcgctcaatgaaaggttgtatgcagatccacttgagggtacacctgaatatgcctttgttccgcatgtgacagtggctcaaaaactatcagatgatgagcattcagacgttcttggcacattaaagctgagaaagattgaccatgaagaaacagtggatcgcttccaccttttatatcaattagagaacggatcttggaccgtctatgaaacatttattttaggagaagagggttaagtacatttgaaaacagtcattgcaacagcacaaacacaacgagaagatgcatattacgttcgaaaagaagtattcgtcaaagaacaagaagtcccgttagagattgaaatagatgaactagaagacgaggccattcattttgtcatttataatgatgaaatgaagcctcaggcagccgctagattgcggatcattgaaggaccaaaggcaaagctagaacgaatttgcgtgttaaaagaggcgcgcgctttcggccttggccacaaactattagaagcgctggaaacagaagccattgcgaatggagcgaaggaagcggttatgcacgcacaagtccaagctcttcctttctacgaaaagaaaggctacaaagccgtatctgaaccatttgaagaagcagggatcacacatgtcaaaatgacaaaaacgctgtctgtttgaccaaaagaaaaagccaggacatcatggatgatgctctggctttttctttatcatcgttcgtcaatggaagaaagcgcaatcatttatatatacgtattaatatgaacgcctttgccttcctccataaacatatctcgtacaaagcgttcccgctttttttgctgtactttcgtttccgcttctgtcactaagtcctcttttttctccagctctctgtataccttgtcatgaaaggtgcgagtaaccttagttactttcgcgtagtcttctttatcctgaggagcaggacgattgatatattgaaaatacagatccggctgaatcggggctatatatcccatcaagaacgcctcctttgcttctcttctactctactattccctaataatgactgtttgaaacacgtctaatttgatatgattagatgtgtttctttttaagattgattaactattggaggactagctttgaaatgcgcacgacgacatgatcgaacgatctcattacatacgtattcgagagaacattatcaattcctccatgacgagggaaaaaaagggcacttattctgcccatattgcggacaaccagtctctttcagattaaatatacatgaagaacctgcctttattcataaacatacgtctcagcaagagctgtgtgaacaagcagaagaacaagaagatcagaaaaaacacgcagagcgagaggaaagtgctgcttataaagaacttgggggcttccgttttccaacaggtaaacaaatcatctcgcaaacgaatgaatcatatgactggcaggaaccaaggtcgattcaatttagcgatgtgatacatttagaagaaaatgaacaagcacataccatcgatctctttccgcatatcacctttagcacaccgcagcttcaagctgtcacacataaagacggtccgatgcttgtgctggctggtgctggcagcgggaaaacaagagtcctgacagcaagagcggcttatctcatgtcacatcatcatattcctgctcaccatatcttactcgtgacgttcaccacaaaagccagcagtgaaatgaaagaaagactgcgcaagcaatatcagctgcacccatcacaagcaagccaagtggtgacaggcaccttccacagtcttttttataaaatgctgcttcacgatgacgcaaacaaatggaacggccagcacctgatcaagtttgattggcagaaggaacagtacattcggaaagccatcatgaatgaaagactagatgaaaaagactaccctaccgatcaagtcctgcaatcgatcggctattggaaaaatgcttttttaccaggcgatcttcctgatttgaaggatgaaaaggaaaaacacatgtggacgatctatcaatcttatgaacagcaaaaacgagacaatcagcaatttgactttgatgacatggccattgcctgcttgcacatgctgactgaacagcctgaactgcttaaacggtatcaagaacggttcaaatatatattggtggatgaatttcaggatataaatccagttcaatatcaattgattcagctgttagctggagaatctgagcagctattttgtgtcggtgatgatgatcaagccatttatgcctttaggggcagtaatcctgctttcattcttgaatttaaacgagattatcctttggctcagattgttcatttacatgccaattaccggtcgcatcatacgattgtcgcaagtgcggatgccgttattaagaaaaatcagcatcgttatgagaaaacgttaaaagccgtccgatcggagacaatccctcctacgctcttttatccatatgacgaggaagaggaagcgaccatgatcgtgtcagatattcaggagaaaattaaaaacggcgcaaagccgagtgatatctgcgtgctctttcgcaccaatacgggaggccgcgcgatttatgagcgtctgcatcaatccgcgattccgtatgagacggaggctggtgtcaaagccttctacagcagacgaattgttcgggttcttctcgcctttctctctttaagtcaggatgccgatgatgtgtccgctatgaaacagctgcttccggttttctttttaaagcagcagaccttaaacacaatgaaggcactaaccatcacagaagattgttcaatggtcgacgcactcggaaaaataacagatattcagccgtttcaacgaaaaaagctgcaatctattgttcctctgttcagcacgttacgaaatttaaagccgtctgacgctgtggcgtttattgaacaaaagatgggacttggtgatttcttaaaaaaacgagtgaacgatacgaatgtacttgaaaaaggggcggatgatgtacgagatgtaaaaaccgctgccaaacgctttgaaacgattgaagcctttctctcacatgccgaacatatgaagtctgccgaaaaggaaaagacagtcgaaccaggtgttcagctcatgacgattcaccgtgcaaagggactggaattccaaacggtgtacatcacttgcgtggtcgacggagcactgccacatgatttctcactcgatgaactcagaaacggtgatgaagaagccttggaagaagagcgccgtttattatatgtggctatgacaagaactgaacagtctctttatctatcggttccatcatttagacgagggaaaaccgctcatcgctcgcgctttttatatcccctactaaagaaaaatcgagcattattcacagaaaaacaacaggcccccctttaagcggagagcctgttgtttattttttgttgttcatcattttagcgatggtattgaaatcaagcttttcttttccacttgtaatcgattgaacgattttgtcttccatttctttaggtacacgtttgttcgcaagctgcgctacttttttaatgacacctcgaaccgttgcttcatctttaaagttagcattttgcaaagaacctgcaagtttaaagacatcgttcatattcacacccgttttattttcaacgcttttaaagaatttattatccattcatttgcctcctctttatggagtaatcaccttactatatgaaaataggcgagatatgtgcctatcctaaagccttgtttgcccaaagagaaaggaaagcaaagggctcccccattgcttccctcaccttcttactgtttagttaaagaaagaagcaccaacgatgattagaaggatgaaaagcacaacgacaagaacaaatgttgatccatatccgccgccgtaacctccgccgtagccgccgcaagaaccgccaccgtaaccgtaacaactcatatataagcacctcctcttctcccttacaaaatatgaaaaatactacaaatggtttggacgatcacataaaaaagtgcggaatttttatttctgctgtttaaagacgtaatctgcctctccatgacgcacaatgaatgcttctgtttctttcgcaaaagcatccatcttctcgccaaatgcctttaagtgctgctcaagatccttcgctttatccgctagatccatttcacccttttcgtgcgcttgctctttcccatcatggggtttagtgaacaaggagccgattaattgttcgaatgcatccattctggtcaccccttctctcttacatatgcatcactcaaaaaaagggcaacaaaaaaaccggataaatccggcttttgttttctcttctattgaggtttctttttgtttccacagccgcagcctgcttttttaattttcttcgtataaacagattgttgatttgactgcgctggataaccttgaagcgtatgtgatggcgtttcagttggtttcatcgcaacccttcctttcctattccatgatagtatatgcattttttgaaagcgtgtctgatcagaatgcctgtttatttcaccagctttgagacaattgcttcaataatgcctgctgctgctgcaatggctaatagtaaattaagccacatgctgatgacaggaaatagtatgtatatcagaagtaaagcagcagtgcaccacataccagtacaccaataacagcttaacagctctcctatccaagaccgcagccctttacctttaatgatgatatatgtctctacttcaccttgttcattgatctcttcttgttcttcatgaaataaacggcggaaaggagcagtaatggtatcaaacacaatgagcctcgtcagtctaaaggatgcgagggcaaacacgacaaatgacaaagcaccgctcaggagcctccacctccttctttctcctttttttcgtcctttctttatatatgcaaaaagaaagacctccatgatgaatcgggcggaaataaaattgggttgtactttttcacactttccgattccaccttgagcctctgctgcattaaataatgtatagataagaaaggagtgaaagtattgtctattgaagaaagtgctgatttattatacacacaactattaaacgaattaatcagcaattatgatgatttcattgaaatcaaagattccgaaaatgtcacgattcataaaacagatgtaacagccgcactctcccttcaagcgaccgtaacgacaatcattactcttttaatccaacttcttgtaccagacgatgaattggctgcagatatcacagatcagcttttagccacacaacaagtgacagtccaaaagaagactgtgattcaaatcatcaattgctataacgtcacgattacactatctgatgcatccattatgaactccgtacaaattctcactcaaacattgaatgtactattagttgaagccggcattctttgaccctttctttttctaacattatgtatgaaagaggtgaaataatcgtggctgaagagaacgaaaaaaaggaatttcaaatcaacactgaggttgatccattaacgagtcttcttgtgagtgatattttaaacaaaaacaatatcacagatgatcagaaagcaaatatttcagatgatcaaagaagaatgattttgaaattagttgaggacttacaaaagaaagcagatgacttcgtacaacagcagcaggagaaaaaaaggcaggctgagtcagcaaaacatgtggaagaagtagcccctgaaccgcaagtacgtccaaaacgaaattcacttcgagatcgtattcaacagcgccgtgatgcgcagcgaaacaacgattaaataaaaatgggttgcgtgatagggtaaatgcctgagacaaaaccatgcattccagcatttaataaagtaaacggaaggaggaatagaaatggattctaaaccatattcttgggtcgctctagatcgtaactgtacacaccacggacaccacggcgattacaactatgaaagaaaagcagtttgtgacggccactattatgatgatgaagatgtcttacaagactttgatcaagtgagttttacaaagcagacgtctgaggaagtcattatcgtcagagactcttgtgacattaacgtctcttctgttgacgcacaggttgcagcatctattcaagtagctgttcaaacagcgatcatcaccattacaaacatctcaatcgcagacggtgatttagcagaccgcgtcacacaagatcttttacaagccgctactcacaaacaaacaaaccgccagaaacttgtcattgaaaactctagaaacgttacagtatcaacaatcgatgcggatatctcgatcgcgattcaaacacttactcaaacacttgttgcgacaatcgttgcaatcggtatcctctaatgtccaaaagcagagcgaaaagctctgcttttccttttataaaaatacaacaaatataaatagtcatttacccacaccaactagagggcgcatacatatgttgttaaggactaaagtcaaataccttgttaaaggagctgaaatccatgagctgcggaaaacaccatggccgacatgatgaaaactgtgtatgcgatgcggttgataagattttagcagagcaggaagctgtagaagataaatgtcctacgagctgctacagtaatttattaagcccgacagtttctggaaaagatacaattccgtttttactttttgataaaaagggcggattgttttctactttcggaaacattggaggatttgttgacgattgccaatgcttcgaatccattttcttccgggttgaaaaattacacgactgctgtgctacgttatctgtattaagacctgttgatgtacacggacatacgctaagcgtgtgtcacccttgtgaccctgacttctttggtctagaaaaaacggacttttgtattgaggttgatctaaactgcttctgcgcaatccaatgtttaaacccagaactagtagacagagtcatgccatcgaaagataaaaagcatcatcaccacggctaaatcaatcgtccgttgacctaatttgtcatgagtcaaagcatccccttccttacgaatgacagtcaatcatgcggaacagtcagcataagagctgccgcttccgcattgattgaaagtagaagtatcaaccggtaaaacaaaaagcttgtagatgatgacagtgctcaaacactcaaacaaatttcctagtataggagggttgaatatgagccgcaaacattcatggaattgtgtagcagaggctgttgaaaatattaacgacttacaaaatgccgttgaagaagaatgtccgaccagctgttacagcaatctcctttctccatcccattcattaggtgacactgtcccgtttgttctctttacctctaaatcaaaaccattcgtcgcattcggaaacgttggagaagtagatgcaggtccttgctttagcactacatttttcagagtcgaacacatctctgaccactgcgcaacactcagcttgcttatcgcatttgacaaagaccgtcatattttagattttacagataaagattccgtatgtgatgtgttccgattagaaaaatcgaagtattgcattgaagtagatcttgactgcttctgcgcaatcgagtgcttaaatccacgactcatcaaccgtaactgctaacaaaaaaagtccctctatgggactttttttatttgttaaaaaccaagtggatgaatcgaggaaatttcatctattgctaattcaactggatttcccccgcccgctgttcgaatgaccactgtatcttcttgtcgatccatgataatccctctataagttttaccatcagcttcaatcaggcaaagggctcttggcatattatgaggcaggcttgtgagaaaatcgactttttcgtcaatgctcatctgacttaaaggctttttcactcgttttcttctaggttcttcttttgtttcatgaaatacaccttctggcggcttttcctcttctcgctgggattttcgttcttgtataagttctgtttcttttgagatgtcttgttctttggtaagctctgcttcttgcatcatgtcttgttcttgctgacgctcaggcggctcagcttctcttttcttctcgatttcttgagccacgggatcctcgtgtgtaccctcttcgatcttgtcttttttactcttagaaatttcttgtggtttttcaggtttctttcgctttctcacaatattttgcatggccggcattgattcatcatagctcggctgaacaatatacataagcggtttctggttctcatcacctttatttgacatactaatccctcccgaatgattcattccttatatatatgagcggacgactcaaatcagaagaaaaataaaaaaacagcatacccttattcggtatgctgcaaatcatttagttgtttagcgggcaatgatatggaagccagaatcaacatgcagattctcacctgtcatgccgcgtgatagatcactgaataagaatagcgctgtatcgccaacttcttcaggagtcgttgtacggcgaagcggtgcacgctcttcaatatccttcagaatggtattaaagccgctgatgccttttgcagacagtgtacgaattggaccagcagaaatactattcacacgaataccttctgcgcctaaatcagctgctaagtatttcacacttgcttcaagtgctgctttcgctacacccattacgttgtagttagaaaccacacgctctccgcctaggtatgtaagcgttacgatgcttccaccttctgtcatcaatgggcgcgctgcttttgctacagctgttaaagagtatgcactaatgttgtgcgccaaaaggaacccttcacggttcgtgtttaagtattcaccgacaagctcttctttgtttgcaaatgcaatcgcatgcgcaacgccatgaatgacttgtactttttctttaattgtagcgaaacatttttcgatttcttcatcacttgtcacgtcacatggaagaatgattgaatcatcgcgctcaagtgtgcttgcaagttcttttacagattcagcaagacgatctccaacataagtaaaaatcaaacgagctccagcttcgtgaagtgagcgggcaattccccatgcgatgcttcgtttgttggcaacacccattaccacgatattacggccttctaaagaaaagttcatatgtaataaagcctcctattttttcaagacatagtattagtacctgatcataatattatcacagatcatgaaagaatgacaatttccgctgaaagaaagtttctttttcatcaaaaaaccgtccacacgagtgaagacggtttgactttattatcgtttgagccggttttgctgataagcaaaatggttggtaggtccgtttccagctccaatattcaaagggtacttgatggcttcatggacaaaggtttctgcagtttcaaaagcttctctcatggaatatcctttcgcaatttcagctgttaatgccgctgcaaacgtgcagcctgtgccatgtgtatgcggggtatcaatatgttcgtttgtgacttctataaagccttttccatcatacaacaggtctgttatcataccgccagaggggccatgtccccctttgatcacgacatgtttcgtaccaagctcatataaacgctccgctgctagatagcgatcctcttttgtctgaatgcgcatgcctgtcagcacttctgtctcaggaagattcggcgttacggcatagctgacaggtagcaagtgtgttttcatcgctaagaccgcatcttcatttaataaagaagcgcctccttttgcgatcatcactggatcgacaatgagcttcatgtcatattgaaccgttttttcagcaactatcttgatcatatctgcactccacagcatccctgttttgacggcatctggcagtaaatcctctgccactgcatcaatttgactttctaacgcctcgattgaaagcggatataccccatgaacacctagtgtgttttgtgctgtaatcgctgtgattgcagacattccgtacacaccgagctcctgaaaggtttttaaatcagcttgaatgcctgctccgccgccagaatcagaacctgcgattgtaaatgcttttttaatcgtcatttcatcacacctctcattagccaatccattgatgataaatggttcttgcttttgccatatcatttgtgccatggacaagggctctgccgtctttaaataagacaagcttatattcatccttttgacaggaaagcaaatacggattttcaaggacatccatccctgctttctttaaccgaagagccacttcgtgtaacgaaggcggagtttcagctgcactgcggatttggactgtattgcggccgcatagtacatctgcctttgctctcttgtcataggagagaaaaggatatgttttcattccgcagcttggacattgttttttctttaaggaactggctgatcggatgtcagaccgttcattggtccataaatcaaacgatcttaatatcggcgtcacttgatgacccgttaaatacttcagggcatctgccacttgatatgctgccacctgctgcacaactggactaatgataccggctgtatcacatgtcattccctgtgcgggtaaatgttcaagaaggcagtgtaaacacggtgtttcaccaggaatgacagtaaattgaataccatagctggcaacgcaagctccataaaggaatggaatttgatgtttcacagcagcatcattagcgatcattctcacttcaaaattatccgctgcatcgacaatgattgaagcgccgctgaccagttcgtcaatatattcagcggtcacatcgacgacgattcccttgacctgtacgtcactatttatctgtttgagtctattttcagccgccacggcctttggcagccgatcctgcacatcttgctctgtgtaaagctgctgacgctgaaggttgctccactcaatataatctcgatccaaaatggtgacagatccaacgccagcacgaacaagcatttcagcactagctgtcccaagcgctcccgcaccaataatgacagcctttgagtcatttaaccgcttttgcccctctgtgccgattggctgaaagagctcttgacgtgaataacgagtgctcaaaatgccggcattccttcctgcgggctacttgctgtcccgtagtttttcaatggaatgcgtcctgcctcgaagcctagccttcctgattcaatcgccagtttcatggcttttgccattttcacagggtccttagcgcctgacacagctgtgttcagtaatacagcgtcagctcctagctccatcgcataagccgcatcttttggagagcctacaccagcatcaataatcactggtaccttcgcctgctcgataataaatgagagattcagagggtttagtaagccttgccctgaaccaatcggcgaagcacctggcatgatagcatggacaccaagctcttctaattttcttgccagtaccacatcatcagatgtatatggcagcacgataaatccttcttcgagtagcatttcggatgcttttaacgtttcgactggatctggcagaagagaccttgagcagccaatgacttctaccttgatcatgtcacacagtccggaagccttcgctaagcgagcaatacgaactgcctcttctgctgtacttgcaccagctgtattcggaagcagcgtgtatttagataaatccagctgttccaaaaagttaggctgagatgcttcgaaaatgttcattcttctcacagcaaaggttaatatttctgcttctgatacgttcacagcttctttttgaatttcaaatgatgggtacttccctgtaccaagtaataatctagatgtgaatgtttttccgccaatatgcagcatgttgtcatcctcctcctacaaagtgaacgatttcgatcgtatcattaggttgaattttcacttgttgaaacgcttctttatcaataatttcttggttcttttccacaatcactactcgattttcaagctgatagtctgatagcaggtcatagatcgttccattctcttgatcgaaatcaacggttctgccattcaattgaattttcatacaaacagtgcctcctttcggtcaatacgaaatgcgtgaagccattcttttttgaccggttcacctaatatcaggtcgcgaatgatctttccagtaatcggagcaagtaaaataccatttctgtaatgaccagtagcaaaaagaatacgccgatcttctggatgtcttccgatgtagggatgctggtcgcttgtcgcgggacgaaggccagcccagcactgatcaatcggcatctccttgatcgaaggcatcagctgtgacgccttttgaatgacagcttcgataccgccaagcgttggaacagtttcccactcgtttggcttcatcgttgcgccaacgatcagtttgccgctatctcgttgaacgatgtaacaatgatcatggtaaatggtgtgttggagtgctggaccatgattccatacagacacacattccccttttactggataaagagaatgagataatccaagctcttcaaaaaaatgaccagaccatacaccacttgctacagttagttcatcacatgtgaatgttcccatcgttgttctaattgctaacgcttctttctcccgcttcacttcgattacgggtgtacactctttcacttctgccccgtatctgaccgccgcctgccaaaatgcccggcataccgcataaggttcgacatgaacatcctctttaatcaaacctgcgcctaagatgttctctgccatttggggcatgcatttttttacgctgcttgcgtcaaaccaatcaaatgtagacaaatgctgcatccggcaaagtgcttgtttctcctcttcggtaaaggctaccttcatgataccgcccactgatgttcgaatatcaatgccagattcatgccgtaaatcgacttttaacttctcgtacaatgcctggcttgctctgcctgcttgaaagaaaatatcctcatgaccctctccttcagcatgtgcaccaagcatcccagcagcagcacttgtcgtttgcttccctgcctcattcgcctcaaataaaacgacctgctttcctgcttttgcaaggtgataggcaatggacatccctatgattccaccaccaatgatcgccacatcataatgcttcttcataaggattctcctttacttgtttagaaaatgcttgtgccatcttgcgcggctgatgatgagtaaaaattccagacatgacagcaatccctttcacattcgcttgtctcaattctggaacgcgctcaggtgtcacaccaccgattgccaccactggtatagacagtacagatgtcagttcttccacaagctgtatgcctcttgcctgaagtcctggtttacaagtggtgtcatatacgtgcccaaacatgacatattctgctccatttttctcagctgctttcccttcttctatcgaatgaacggagacacccacatgaagatgagggaattttttccgcagctcttttggcgaaaagctatggcccgggagatgtacccggtgaatattggtgagcagcgcaacgtctactctgtcgttgatcatgagcttctcttttggtacaccttctaaaaggagacatttcacgatatcaacaagctcacttgctgttttagaccgttcccgtatatgaataaaatccacttcagatacaatggctattatttgtttgatcagctcttccgcaggaagcgaatcatttgtcactgcgtggagttccatttgcaccaaccccatctaagcatgctgtttgccacatttctttttgatacgccatctcccagaaatggtattcgtaatagctagaaatcacaaaattttctttcatattggcctgcacatgttctggtgctttttcggctagttcatcaaagcggttgacctgttcaaagacgagctccttaaaccaatcccctccatatgtcaaaatccattcttgataaatcggatggtcaggtgtggtttgtttcagcttttcacccacctcataataaagccagtagcacggcaataacgcagccaatatctcttcgaatcgtccgcttttcacagatcggtacatatgtgaggtatacgcgtaagcagttggagatggcttaaagttctcgatggcttcatctgaaatctctaaaagctctgtaaactttctatgcagcgacagctccgcttcatacgtcccctgcgcatgatatgccattctgcccgtcgtatgtaagtcctcactaatcgccgctccatatgcttgcacctttgcaaaatgagttaaataatatgaatcctgcatcacgtaataagtgaaacgatcgagtgacagcgtgccatctccaatccctttcacaaaggggtgtgtaaagcttccattccaccatgttgctgctgcttctttacattcagttgaaaacgtcatgtttctctcctcctgtttttccatataaaaaaaccactttccatatggaaagtggcttggaatttgtcaaaagcataatcaaaaaccgcaccacttccctacgcaggtatgaacctgttcaggtaatgagggtctaaaagtcaatacttttatctcagcccttttaaaggactcccctagtggatcaaatatatgatgttgtacttctatcttaatcaggaattgttcattggtcaagggttcattgttactctaattgggctcttagtcctgccacatattcacgagagcccgacacaagcacacggtcgccgcttctaagcgtcgtatctccatgtgggactaaactgtctacccctctgaaaatacggacaaagaccaaatcgccggtaaacggaaactccctgagcatgacattgtgaaagcgatgattgttcatttgaatttgatacaaggaagtatcctcatttgttaataatcgaatcgcatctggtgcttcaatcagagctcttagcaccgttttagatgataggaaattagaaaacgtatcaatgcccgcttccttcaatgtcagctctgcctcagctttattcacactcgcaataacttgttttgctccttcttcctttgcaaataaagcaatttccttattttttgtctcactgcctgttgcgacgacgaggacatcctcccggccaacgcctgcctttcgcagcgtctcatcgtcgtacttctcaatcgattccacttcaaagatggagtcggcaagcagcgcttctttattttcttgaaagacatgcaaaattcgaatatcatattcatcctgatgtaaatcgagtgtgacaggtaaggtgagctgatttgcaccaataaaggtcacacgttttttatggctcgcagcttgttcttttttaaacagcgctttaaaccaaacaggcgttaaaatactcgtgagtaccgcgactaaaatcagcgcgccagacattttgtgatcaatgactccaagccgctccccgatcgtcgctgctgcaatgacgagtgataacgtcgatgttaataaaaagccagagccgatcacttttttcatgtcataccattttttcaaataaaggatcggaatgagcttactaatcagtaatgcaataaatagcagcgggatcatgatcataatggttgggtccttgaacagtgcccatatattcaaatcaactccgaccatcacaaagaagatagggatcaaaaatccgtagccaaatgaatccagctgctgaacaagctctttattcggcgaaagaagagacacaagcacacctgctaaaaatgccccaagaatattttcagcaccgagtgattcagataaggcaactaagactataatgagagtaaagatcgcccttgtcccaatttgcacggtcccttttgacatggactgaaaaattgactttgtcttaaatacgcggccaaataaataaagaaggatgcctgcagcaaataataagagcagaagccacatattccctgtaccatcgccataaatggaggaaaatacagcaagtaaaatcattgtcaccaaatcagcaatgacagcgacaagcaagatgatttgaccgatattcgtctgcatcaatttttcctcttttaaggtgggaaccactacccctaatgagatcgtcgatataatgagcgtcattaaaaaggcattttggataaaccctgcaagaacaaacgcataagacaggataaaagaaatactaaatacgccaagaaaaacaatagtggctgcaataaacgtatttggttcttttagaccatttggcagttctcgtgctttcttctttgactcgaaagaagaaaaatctatttcaagtccacttaaaaacatcagaaaaataaaaccgagcatggataacgtatctaaccacgcatcatgttcaacaaccagttgaagaccgctttttccaatgatgagccccatgatgatctcagcaacaacgaccggaatggtcagcttaaatcggtgcaataaaagtggggtgaaaaaggcaacaataataacgacaacgagtgatgaaacagatgtatgctccattggctaaagcctcctaacattgatgtttaatcttttaaggtttacgttaaagcattgattctaacaattgcctaaatgaaaagaaagccattcgttatatgttctaaaattcaaacttctttaaccccgatgaacggatgagtaaaatcaggaggaaatcttatgaaatttgatatcattggtgatatccacggctgctacgaagagctgcttaccctcatacacaaactaggatacgaactcaaacatggattacccgtccatcctgataagagaacgctagcacttgtcggtgatttaacagatcgaggacctcagtcagtagatgtcatgcgctttgtcattcatgcctacgcacacggcgcgatccgctacgtacctggcaaccattgctttaaactatatcgctatttgaaaggaaatcccgtgaaattacttcatggcattgaaaccacagtgaacgaaataaaaatgcttccccttcatgaacaaacgaaattgtcacatgaatttaagcagctatttgagaaggctccgctttacgatgtacttattcctgatgaactaatgattgctcacgcagcgatgaaggaaaaggacattggtagaaagccgaacaaacagatgcgatcctatctattatttggcgcagtcacaggagaaacatggccggatggacgacctgtgcggaaggattgggcaaaggaatatcgcggaaaaccatgggttgtctacgggcatacaccagtgaaagaaccgcgattcgttggcagaaccgtcaacattgatacaggctgtgtatttggccaccggctgtctgcccttaaataccctgagcttgaaacggtttctgttccatcctctatgccttatgacgattcaaggtttcagcatttcacatcataaaaaaacccggtcctgagcttgcaggtagccgggtttctctatttaaagcagcaatgatttcatgtcttcaggaagcggagccgagaatgtcatttcctccccggtcatcggatgaggaaagacaagagtctcactatgcagtgcctgccggttcatctgctcactcgtcccgccatataacgtatctccgatgagcggatgaccaagatactgcatatgaacacgaatttgatgggttctccccgtttcaagtgccagcgtcacatctgacatcttcaactcagcgtccaccgctcgcactgtaaaatgcgtcacagcttcctgcccagtatcatcgaccattcgctcgatgatactatctccttttctggcaatttttgcacgaatggttccacgcttttctttgatcaagccatgtgtaaacgctctgtatgttcgtttgaccgctccacttttctgcgcttttgataaaaggctgtgggcaaagcgatgcttggccacaagcatcacgccagatgtatcacgatcaaggcggttcactaaatgaaccgtcagccgaacagactgctctgcataatgatgcagcaatccattcgcaatactgtgctctgggtgctcccgagaagggatagacgggatatatggctttttattcagcacaaggacgtgctcatcctcaaataaaatatcaagcggaatctgagcaggcttcagcccttcactcactttttcctcggggaataaaatagtgagcctgtctccgttatgcagcttgtatctcacagtcacatgctctccattaatgaggagatcaccgccatcaaatttaatatccgtcagcattcttttcgaaatgccaatatctattaaataatcctttaaaagcagcccttcttctttggctgtcatggttttgtttagtgtaaagtattccagcgagaacgacctctttcttattcaccttttccgataaaggaatcttgcacccttttccaaaacggaaatggtctaaatcgggcaaagcggacattctcgtctgctacccggcattgaatggatttgacgtccttatgaagcagcgtcaaatgatcaatggttacctgaaaatcgacatcattcctcggtttaatgacacaagtatgatggtctggtaaaataagcggcgaaccgaccgttcgaaacactctgttgttgattgaagccatttctgccagctgaatggctctaatggaaggatgaataatggcgcccccaagtgctttattataggctgtactgccagacggtgtagacagacaaagaccgtcacctctgaatgtttcaaacagctgacccctaatttcaacatctgccacaagtgtcccttccatacttttaatcgtacattcattcatggctaaatatttctcttctctgccgccgtcgttgtatctgacaatgacttctaagattggatattccacaatgtgataaggtgttttcgctatagctaagacgagtttttcaatttcacttggcacccagtcagcataaaaaccaagatgacctgtatgaacacccacaaaagctgtttcattcagacggtcgctataacggtgaaatgcataaagaagggtgccgtcaccaccaaccgtaatgacaagatctggttcctcttcattgagttccattccgaaatccaataagtaggtctgaattttatttttgagtgtgtcagatacagaattccctttcgaagaaactgcaaatttcatgaattcttctccttttccaccttgctgctataagagggcagcatcatatttgatcaagcacaggctcagctatcgtttttctttttccgggaaaatgctacttgtgcttcttgaatttcccctctaatttcggacatctcatcatcaagaagagatgctgcctcagaagctctttgaaggcgcagcttgactttctccgggatattcccgctatatttataattcagagaatgctcaatggtcgcccagaaattcatcgcaagtgtacgaatttggatttcgacaaggagctgtttctctccattgatcgtttgcagcggatataacacaacaaggtggtacgaacggtatccgctttctttatgctctgcaatatagtcgcgtttatcaacaaccacgaagtcttttcgtgactggagcatttttttcacgacttgtatgtcttctacaaactggcacataatgcgaagcccagcaatatcctgcatcgtttcaatttcatgcattgggatgtttttacgctttgccttttctaatatgctggcaacgggtttcactcggcctgtgacaaattctactggtgaatggtcatcctcgaattcatacagctttcgaatgccttttagtttcacttttaattcttcgactgcttgtttatacggtgcgaggaattgatcccattgttttttgtccatgaaacttcccccaattccatatacctaattatttcagaggaatgtgctcttcactttctcttccatatctccgtaattggcattgtctttaatattgtcgattaaataatgtaattcttgatgaagctgaatgagttctaacgaatggcctcctgctgtcaaatagacagggatgtcaagattcattgcttcttttaatggagcccatgtatgttcccctaagataagatatgaaaaggactcctcgttttcaagtatgtaaacgaacgcaaagtgatcagaatcaacaagcatttgtcctgatgcttttgctttttggatttgctcttctgacttggtcgtcaaaatcagcctgtcttcttttaaagttgcttctgcgatttcaattcggttttgcatcatgatctcctttacaacaaagtacagctttattttatcatatcaagttcaatattgataaaccgaactttttgagaaaatcctattttcttcttataaatgatcctttcacgtaattatccattgattttggtacatgcggaaagagaaataatagataaaaactgtcttttacatgatgaacatacttcatgtacaataatcatatttcctctaaatgaaaggttgatgtcaaaatggcccaggaaattgaaatagaactaaagcaattgttaatgaaagaagaatttgaacagttgaaacaacattttcaattgaaggattcggattttcacacacaaaccaactattactttgatacaccccaatttgatataaaatctcaatttgctgcattaagaatgagagaaaaaaacgatcagtgggttctcacgttaaaggaaccacacgaaataggcttactcgaaacccaccaaacaattgctcctccttcaagccttgacgattttcagctgccaaaaggtgaagtggctgacaggctagaccatttgaacattcaaaaggatcaaattgtgtattttggttcacttgaaacgtcaagagctgaaaaaatgatcaaagaaggcttaattgttttggatcacagccgatatttaacaatagaggactatgaacttgaatttgaagtgagcgacctggaaatcggacaagccgcattctccgcattgctccaacaatttcaaatccctgtacgaaacacgaaaaacaaagttgtacgtttttatgaagagaaaatgaaaacacagaatagatgaattccttgaaggaggaacaagatgaacgtcaatcaaattcaatcctttatgcagctccaagcgcttaaaacgttacaatcagaccctggacaaacgcaaatgccgggcggccaagaatcgaatgcacaagcttcatttcagtcgctgctgcaagattttttaggcggatcagaattatcacgcctgccgctttcaatttctgcattgatgggaacggacccttcaacggctccgaacacgcaatacgcgcgtacaaacccatacttatctgctatcgctggtggtgagcagcttcaagctcaaccttcatatgcaaatgacgctcaattgaatacagcaaatggtattggaaatgtcttaaacaacagctacacgccgccgcttcaaaaggctgtttcaagcggctcatcatcaaaagaaattaatcaaattgtgtcacaaatggctcaaaaacatggtgttccagaaaagctgattcatgcggtcattaagcaagaatccggctatcgtacgaatgcggttagccatgcaggcgcacttggcctcatgcagcttatgccttctacagctaagtcccttggtgtgaataatgcctttgatgcggcccaaaacatcgaaggcggtacgaaatatataaaacaaatgcttcagaaatataatggaaatgtctcactcgccttagctgcttataatgcaggctcaggaaatgtcgataaatacggcggcattccaccatttaaagaaacacaaaattatgtaaagaaaatcacagcacaatatttcgcttaaaccgaagagaataacctcttcggttttttgtatgtcgcttttcacccttttttgactgaatgtgttatgatatggtcaattgatcacggaacccgcctctccccttatttccaatagaccaaagcggtttgtttgtggaattgagttgaggttgttaaaataaatatacaagaatagaaacaataaaatagaacaaactgaatatcacttttgaaataaatgaattcacaatagggcgcttcatcctattaactacgagtaaaaggagtagtcaacatggtacaatcgtttaacgcaccttacgaagcggttggagaggaacttctatcgcaacttgttgatactttttatgaaaatgtaaagtgtcatcctttgcttcatcctattttcccggatgacttaaaagaaacagcaagaaaacaaaaacagtttttaactcaatatttaggcggacccccgctttatacagaggagcatggtcaccctatgctacgggcgagacatctcccttttccgattactgaggagcgggctgacgcatggcttgaatgcatggaggatgcaatggatcaagtaggattaaccggcgatattcgtgactttttatttgagcggctctctttaacggctcgtcatatggtcaatcaaacacctgaaaaggatggacgatcttgagctgcaatacgcacgatcaatatttctcacactgtcacggacatcctcaaaagccgattgaaatctatgtattcattgaccctctaagtccagactgctggttattagagccatccattaaaaaattgaaaatgaagtacggccgttttttcactttacgaacggtgacaagctctagtattaatgcattgaatcgaaaacgaaaaaagcatttactcaccgaagcatgggggaaattcgcgaccaaaactcagaccaaaaaagaacaaatgctgtctgaacaaattgtgacctcaccctatctcgcctcgcttgcattaaaagcggctgaacttcaaggcagaaaatgcggaatgaaatttctgcgtctcattcaagaatcacttttttgccatcagcaagatgtcacaaatgaacatgtactgctagaaaatgcaaaaagcgctggactagatatcgaggaattccagcgcgatattcattctcaaagtgctgtcaaagcactaaaatgtgatatgaaaattgccgctgaaatggacgtgtctgagcttccgacctttgccttttttaatacagtaaacggagatgaaggattaaaaatttcaggtgcgtactcttacgatgtgtacgaggaaatcctttttgaaatgattggtgaaaaaccaaccccatcagtacggcctccaattgaatggtttattgcttactttcaatttgcatctgccaaagagattgcggtcgtatatgacctgacacttgaagaagttgaacgagaaatgaaaaagctggctttcgctaaaaaagtcgaacgtgtacaagtgcatcaagaaatgttttggcgctacaaagaagatgatcatccttcagatcttgatgtctatcgctgtgagaatgaacatgggtgctgacccatgttttttcttcacctcaaaaggaacactcgttcttttttaaaccacgaagaaaccgcgccgggataagcgcggtttcactatgtcttaacgacaacaaaggggatgggagaaatttttcacggtcaaacaaaggggtaatgtttgtatgtgattaatttcacatctgtagtatatcaaattttgtcgacttatgacaacagatatactatatgttcatatttttgtcacaaaacataagagggttgtcactttcatatagtgaaagtaacgaaaaaatggagggatctgcatgcgcagcacaaccattggacttgtttccattggcttatgtttctttttaaatatattaggcttaatgaaaatgcttcctctttatctcacatcgcctctcttatttgctgcaatactttttacactttatcgaatgaaccatcggaagacctttaagggatttaaaaggtgatgataagaagcggcctctacatgcgaagaggtctttttttgtgagaaaaaaactcctgtcaaaagatgagtttgcactcacacgtctgacagaagtcttttcattactcacccgttttagagatgagctcctccatttcttttaatttttcttcgaacaattgacatgctgcttcgattggttctttggaagccatatcaacacctgcttttttcagcacattgattggataatcagagcttcctgctttaaggaagtctgtgtagcgctccaccgcaggttttccttcttctaagatttgcttgcttaatgcctgtgctgcactatagcctgttgcatattgatatacataatagttgtaatagaagtgagggattctcgtccattctaatccgatttctttatccacaaccatgccgtctccaaaatacttcttgttcaggtcgtaatagaggttcgtcatgaattctggcgttaaagcctctccttcttgtgctttcacatgaatcagatgctcaaactcagcaaacatcgtctgtctgaataccgttcctctaaatccttctagcaagtgatttaacacatacaaacgctgttttttatcatctagatgattcagcaggtattcgccaagtaacgcttcatttgtcgtagaagctacttcagctacaaagatgctatagtttccatacggatatggctgatgctttcttgtatagtagctgtggacagagtgcccaaattcatgagccagtgtaaataaattatcaatgttattttgccagttcatgaggatatatggatttgtgccatagcttccagatgaatacgcaccgctacgtttccctttattctcataaacgtccacccagcgattattgagtccctcttttaacacggatacatattcttctcctaatggtgctaacccttttagcatataatcctttgcttcatcgtaggttagcttcatgccagcatcttttacaagtggcgtatacaagtcatagttatgcacttcatcaagctttaatacctttttacgcaattcaatataacggtgtaataacggtaaatattgatgaacggtatcaattagattgtcatatacttcttctggaatactgttccgagatagtgctgattctcttgccgatttataatttcgtacttttgcataaaaattatcctttttaatcgaaccgctcagtgtcgaagcaagcgtgtttttatactgatcatacgttttatacacagctttaaaagcattctttctcacttcacggtcatcactgtttaaaaatgtaataaagttgccgtgggtaatcttcttttcttccccattttcatcctttacagaagggaacgaaatatcagcattgttaaacatactaaaagtagtagatgaagttgagagaggttcagatgcctcagctaataaggcctcttgctcctcacttaaaatatgtggacgttctttattaatttcttcaagagcatgggaatacagttttaattcttctttttccaaaataaactgctgcaatttatcttcttgaatcgataaaatctctggaacaatataagcagaagtactagaaagttgtgtaaataaattcgatgctttatcattcagcgcttgaaatgatgagttcgttgtatcctcatcgtatttcatgtgcgcatatgtataaagcttaccaagcttttcagaaagctgatcctgaaaggttagggcttcatacagtacatcagcagaatgggcgagcttgcctttaaattgggcgagcttaggaatttcttttttgaccgcttcgaattccttgttccatgcatcgacgctttcaaaaatatcttcaagccgccatttgttttcttcttttacttcgcttctgtctggtaaatggttgtttttgctttgtgaagtcatatgaatcccccttgcataagttgtgttgaaccaacctttcggaaagtgaaagaaattggtgttgtatttatcttctttgttttgaactatatttgtcaaatcatatgcagaaataaataccaaacagactaaaaaaatgagaaaaaagcgtttctttctattcaatcgcagcaccacctttttcttatcatgatcaaagtgggcatgaaacatgctaatgaaataagaaagcatctcgtttgaacgcttcatctactgtttgtatcggcagttgttttgacactacttcataattaccctctttcgtcatgtacaaaaacccttgtctgacaagcgcatgaacatatgaggtgataacctcttttatttcttctattgaaacatcgccatatcgaagctttacttctttcatctggatacaccgcttcatttctttcatcagcagttgaatcgtcactggactgctacctttttttcttatgatccaatcatatagacacccctgccagacataaacggggcttgtaaagatgtacgcttctggcagcgggataaataattcagccggcagaaaagggaaagctgtttgatgatgctcataaaaaatgtctcttaatcgtttgctttcatttgataaaatacgaggtggccgctgtctaaattgctgtatacatcttagccattgcttggagacttggcgcttgcttgagggctgcgataggatatctgaaaattggcggtatgctgttggcgatctgacagtcataacggcacatatttttgttggttgaaatacaaggaattgagcaagatggatgaatcgattctgaagcggacaataaaaaatcaggcttcctttctgtgattcccttaacattccccaatgaatggaggagaaggaaaagagctgggcagattttcgctttaaacgatttgctcctatgatccatatagggaagtgccctgcttgacggagtcctgctgtccttttacttagctcttgctgcgaaatatttgaacattgatattcgattgcatagcttgttcctccaatagagacggccacgtcaggacgctgatgaacctttgacacatacttttcaagcaccggtttatgcccaagccgctgaagccaattcataatggcttcttttccggcctgatgataagccgtttcgcctgaggctagtggacatgcagtgagctgtttatgtgcaaaatgataaacacgctgttcaccaagctttaattgcacttcttccctgcattctgggcagtaaaacttgcacgtcgtcctgacatgctccagccggtttttagataaatgatgtgtaatacgaataagcttaccattatccatgatcgctgtattcattcagctcgccccttagtctttgatgaccgtattatagcttgttcatctataagagagcgaataggcaaaatgaacttttatggtgtgaaaatatgattttactgatgttttactgaggaaaatgaaaaaccccctctgataaaaagggggaaaatacaatctttatagtaatggcgataataatcttgctgttgattcaaagagccttacccttaacggtctctttgcaaattcttctgggattatctcgtgtgactgctctaaatcacctaagaagtcgtttacgagcttctcagtgcttctcgttttgtagaggaaggcattcacttcaaaattcaaatgaaagcttctcatatccatgttggccgttcctatcgaagccagctcgctatccacaatgataaatttactatgcataaagccttgatcatattcatacacctttgcccctgcttctaaaagctccgggaagtatgaacgggacgcatggaagacgatccgtttatctggattcttcggtgcaataatccgtacgtctactccgcttaaagcagcaattttcaatgcagacaaaatatcatcatccggcacaaaatatggtgaagcaatccaaatagactttttggcagagataatcatggagaaaaagagatttttaatgacctcccactgtttatcagggccaccagcgatcatttgtacgccttctgttgtactttcaagatggctgaaatctttaaagtagtccacacctgcgcatctttcattcgtcatatagtaccaatcctgcatgaaaatctgctgcagatcacgtacagcttcacccttaatcatcaaatgagtgtcacgccaaaaaccatattgtctgcttctgcccaaatattcgtctccaatgttcagcccgccaacaaatccaacttctccatcaatcacgacaatttttctgtgatttcggaaattgattttattatttaacagaggcagcctcacaggtaaaaatggaacgatctgaacgccagccttttcgaggtcagcaatatattgacgagagagcttcaaactccctacatcatcatataaaaagcggacaatcacaccatttttcgctttatcaatgagaatatcctttaattcttgtccaaggtcatcatgacggagaatataatattctaaatgaatgtgatgtgtcgcctttttaatttcttcaaaaatatgagagaatgtttcttctccattggtcaggactttagaggacgtgcgatacgtaataggggtatgtccaagtctgtgggccagcttaaataagagctgctgatgatcacccatatgtgtcattttctcaatcgcttctctatgaatatgttcatcttcctggattaactgttcgtccaggatggctttcttttcaaacagccggcgttttttgatattgcgtccaaagaaaatatagaacagaaagccgaataacggaaagctgccaagcaggacaagccacgttatcgtttgagatggattccggttctccaagaatatgacaaacccaatgaagataatcgataaagtgaatagaacactgacagaacttaatacactgaccgctaaatcaccagcaattaattgaatgactaaataagcacctatcgtaatgataagaaaaaatagaactttgactaaatttctcatttcattttctccttgccgatctctttatttacctattcattcagataaaaaagccgattcctctatagaaatcgacttttgttggttacgagaagtgctgttgaatcgtttcaagggcatttccttcgataatcagctgaccgtattctttcagtctgtaaatgctgaccactgattcatgagcatattcaagtaaaatgctgagcttattctccacttgctcatctgacaaatcctcgtggaagtcaacatatagataataacggttttcaaacgaatataaacttgtggtaaaatcctgcatatttaattgagaaagtgcaatcaaatcttcaaagtcatccattttcaacacaaattgaagttgaagttttttgtccttctcattatgatcttcttgatcctgctcttctttttgaaaatcatcaagcagtgcatctagactttcttcatctgtttgatcttttttatcttctggaatcggcaattcgagcttttgtccatctttagaaagttgggctttcgtcacgacaatttcaagacctttgtcaagtgcctgcacttgaatccaaagcggcccctcaactgcaaattcttcttcttcgtgcacttcgtccattacttcccaaaacagctcttcactgcgttcacgattataccaaatctcttcacggtcaaatccgcggtcttcaatatcaccgtaggaaatataaaatttcactgtatgttcattaattctttcgatttccattttgccaaccttcccttctatataagatgttgaagggacatacaagctcccaattaatagtactttactacactttacccgttccgtctacatgttaaccttttaaagaattgaaggtatcacttcgtactgtctattttatgataaaacatgaataaaagaaataaaaacgcattttttgcagagaaaacttacagaaacatatatttgaattgtcctcatatattggttgtacgagctctattagacatgaggtgaaatagatggaaacagagtggatcatatccttactgatgattattggcattgatctgattttaggcggagataacgcattgatcattgcgatggctagccgcagcttgtcaaatgacaaacggaataaagccatatggatcggcacacttttggccgtgctgatgagaattacaatgacaggtgccgcagtttatttattaaccatcccttatttacaatttatcggcggactttttctcctttatataggatacaatttgttaattgaacaaaagaaagaatcgattcgcattaaaagcagcggctccctttggcgtgcggttcagaccattgtgattgccgacctctttatgtcacttgataatgtgattgcagttgcaggggcggcaaaaggcaacatgctgctgactacttttggcctgatgatttcagtaccgattattatttggggaagtaaactgattcataccgctctaaccaaatttccgtatcttttatacggaggaagtgctcttttggcttttactggcggtgaaatgattgttcgtgatgtgaaattgaatgaatttatggctcagcatgcgactcttgaattgatgcttccgtttttaacagtcgtcatggtcattttagccagcctgttttacgaacaaacggctgaaaacaaataaaaaaagctgccaaatcatcggcagcttttcgttttttctattagttagcaagtcgctgtgcttctcttagttggaatgtacgaaccgttcttggaaggaaacgtctaatttcatcttcattgtagccaacttgtagtcttttttcatccaagataattggacgtcttaaaagacctggatgctcattgattagtttatacaattgttggagaggcattgtctcaacattcacatttagcttttggaatacttttgaacgtgttgagataatttcatctgtaccgtcttcagtcattcgaagaatttctttgatttcatcgattgaaagaggctctgaaaagatgtttctctcttgatacggaatattgtgctcttctaaccacgctcttgcttttctacatgatgtacagcttggtgatgtgtataatgttaccataaatcttcactcctcaatttgtagaatgaatattgatctgtattcttaaattaaaattgttctaaataagtaatctttatagtgattatactataaaaaagtaagtgtgaacagattttcttgcaatttttgtgacaaaaactagacaatttcattcattttctcgtgttgcttgatgtctgaacattctcatttagtcgagatgatcgaaaatatttttttgttttctattttcaatgaccttcaatacatcatcaacatcttcatacgactgcccataccattcttcatctttatacgtatggattcgttcataggttttcctcattgcctccatcatttcttcttcattatctgtaagaggcgaccaataaaggatttccatgcggttcacttcatttgttgcaagtgacctgcgtttataaccgattgattctgcatgcttgaagtgctctctttggtaaaactttagtcgttttgcagtatctgcatcatcttcatctacaggctcaacctcaagcaagatcggtttctttttttccttcagcttatgaatgagctttgatccgaggccttcacctcttgcatctctggaaacaaataaataatcaataaagataaaattatcaaattcggcgtacatcatcacatgatgaggtccttcctccttatgataaacatcacttctttcctttaataaagcttccatatgctcttttgacttcatttcttctatcgggaagtattcactgagcttttcataccaattcatggatccgctccttatgatatcgttaagaaccacttccttagatattcccgatttcctgctatttaaacgcctgtactagtaagacgcagcaaagtctcctctagtttcacttttttttcaaacaacagaaaaaagttttatatcgaacgttccatgagtaattgaaaacagacaaacaggatgagtgtcatcccggtttgaaacatgatgaaataaaggtacttcctgcgacgtgcttcctctttctgattgcttgttttccggtgaagcatatattccacggaaaaagacacgatgccaacgagcaccataaatatgagcatccactgtcctccatttggctttctcaaaaatgacgttgaaaaaagcatgaatacaatgagaaagtgaaagaatgaatagcgaaacgtcttccatatcgacatctgatttcctcctagaacccgcttgttgttaactagaaattaccatcatctcgtttttttgtaaaataaaaaaagaagcactgacatagcagcgcttcttccttcttatcattgttttgcctgaagctctttgaattcttcctctgtgcagctcacaaagtgacctggcttcacttcacggaactcagtgtttgttcctttgtgaacagatggatcatacttgatccgtttgcggttacgctcataatctggatctggaagcggaatcgcagataataatgattttgtatatggatgaagcgggttttcgtataattcattcgctggtgccagctctaccaatttcccgaaatacatcacgccaatacgatcgctgatgtattttaccatggacaggtcatgggcaatgaataagtacgttaaccctttttcttcttgaagctctttcattaagttgacgacctgtgcttggatcgacacatctaatgcagagattggttcatcggcaatgataaaatctggttcaactgctaatgcacgggcaatcccgatacgctgcctttgaccaccagagaattcatgcggatatctgtttgcatgctctttgttcaagccaacagtttcaagcaattggtacacacgctctttacgtgctttctttgttttcgcaagaccatgaatgtcgatgccttctgcaatgatatcaagcactgtcattctagggttcagtgaggcatatggatcttggaagatcatctgcatttgacggttgaactcaagcattttttgtcttgatttcttcccgtgtacactttcccctttataaagaacctcaccatctgtcgcatcataaagcctaatgatggaacggccagtagtggatttaccacaaccagactcccctacaaggccaagtgtttcacctttataaatatcaaatgaaacgccgtcaactgctttcacagtccctcttgctgtatggaaatgctgctttaaatttttgatttctaacagtttttctgccatgctattcaccctcttttactaatacaggtttttcgtagctaccttctagttcacgcattctcgcctttacagaagcaggcggttcaactttaggtgcattcggatgaagtagccatgatttcacataatgcgtatctgatactttgaacattggcggttcttgttcaaagtcaattttcattgcataatcgcttcggagtgcaaatgcatctcctttcggcgggtttgtcagatctggcggtgttcctgggattgcagtcagctttccttcatctccgccatctgtatcaaggctcggcattgacgctaaaagtccccacgtatatggatgttgtggattgtagaaaatttcatcaaccgttcctgtctcgacaatctgacctgcatacataacagctacacgatcagcgacgttggcgacaacacctagatcatgtgtaataaagataattgacgtttccaccttttgctgaatttctttcattaattctaaaatttgcgcctgaatcgttacatctagtgctgttgtcggctcatcagcaatcaatagctttgggtctgctgcaagtgccatcgcaatgacaaccctttgtctcatcccgccactaaattcgtgtggatattgcttaattcttttttcaggcattgcaatcccaacaagctccagtaattcaatggctcttttttcagccgcttcttttgaaatttgttcgtgcttgaacagcacttctgtaatttgtttcccgaccttcatcgttggattcaaagaagtcatcggatcttggaagatcattgagatgtctttacctcgaatgttttgcatttgtttttcagttttcttaacaatatcttgcccatcaaacaggatctgtccacgcttgaaataacccggcggcatcggaattaatctcatgatggcctgtgatgtcacacttttaccagagccagattcacctacaatagcaagtgtctcgcctttatttaagtggaagttcacaccacgaatagcttgaacctctccaccatatgttttaaatgagattgcaaggtctttcacctctagaatacgttcacgttccatcctaatcactccttatttacgcaacttcggatctaaagcgtctcttagtccgtctccaaccacgttaaaaccaaacattgtaatacagataaatgcggctgggaaccataatctccacgggtagtacgtcatggctggaattccgtcagacgccattgttccccagctcgctaatggctgaggtacaccaagccctagatagcttaagaatgcctctgtaaaaatagcagaaggaatggttaatgtcatcgtcacaagaattggtcccattgagtttggtattaagtgtttaaataaaagtctagatgttttcgcacctaatgtttgtgcggcaagaacgtactcttgactcttcaattgtaaaacctgtccccgaacgatacgtgccatgttgatccagcctacaactgtcatggcaaggataatcgttaataatccttttggcagaacaaccatcattaagatgaccattagtagtgttggaattgcccataaaacgtcagcaatacgcatcatcacttcatctgtacggccgcctttgaatgctgcaatacttccccaaataatcccgatgatgacgtcaagaatagctgcagcaagaccgatgaagatcgaaattcttgccccgacccatgtacggacaaacatgtcacgtcctaaatcatctgtaccgaaccagtgctcttttgaaggcggctggtccgcattcagtaaatcagtcgttgaataatcatacttagaaaaaatcggaacaaagatggccaacatcacaataataaaaatgattgtaagaccaaccattgcaagtttatttgcacggaagcgaagcatagcatccttccataaagatagactaggtttagaaattttttcggattctgctgcgtcagctgtcgcaggaacaaataaatcttttctcatctcttccatgtgttagacccctttcttcgccttcgtcagtttaattctaggatcgataataccgtagaggacgtcaacgactaaaatactaattaatagaataatactgtagaagactgtgacacccatgatgacggtgtaatcacggtttgtaatacttgtgacaaagtgagagcctaatccaggaataccgaaaatcttctccacgacaaaactacctgttaaaactgaagcagccattggtcccatatatgtaatgacaggtaacaatgcgtttcgaatggcgtgtttaatcgtcacagctgatttcgttaatcctttcgctctagccgttctaatgtagtcactgtttaaaacttcaagcatacttgaccgtgcaagtctagcgataaatgccataggcatgaaggaaagtgcaatagaaggtagtacggtgctggcccaagtctcccatcctgcaactgggaaaatcgctataacgcttgcctcagatgcaaatacatattgtagtagcgcagctaaaatgaaacttggaactgaaattccaaagatcgttaaaatggcaatcgtatagtcttgccacttgttatgatagagcgctgcaaggaccccaaacaatacaccaaatgctaatgcgaggagaattgcctcaattccgagggtaaaggaaacggggaatccagaactgattaagtcatttacagtttgtcctttatatttaaatgagggaccaaaatctaattttgcaactgaacctaagtagcttacatattgaacaaataagggcttgtccaacccgtagtgctcgtttaggtttgcttcaatttcagcaggaagtttcttctcaccagagaatggaccacccggtgctgcctgcatgagaaagaaagttgcagttacaataacaaacagtgtgattaaaatatatattaatcgcttaccgatatatttaagcaacggaattgcacctccatgattttacaacattttctctaatcagcaagaaaggtatatggagagacatcctccatataccttaagatccttgccgtagatctcttacactataattcttacttttcgaaatgtgcccatttgtattgaacatcacctagtccagatacaaccacaccttttagttttggatcttgtacccaaagctgagtgtagaagtaaattggtgctataggcatatcgttgacgatgatttcttctgcttttttcagcatttcttcacgcttcgttttatctgtttctttcgcagaatcattcaacaattgtttgtactctttgctttcccatccagtgtcgttgtttccaccgtctttatctttgtaaagctcaaggaagttcactggatcgttgaagtcacctaaccagcccatacgtccgatttggtaatctccactgtggattttgtcgatgtatacgttccactcagagttatcaagttcaactttcacacctaaatcttttttccacatttcttgaattgcttgtgcaatcttttggtggccttcatctgtgttgtaagaaagtttcaatgctggaagatcagaaacagacttataacctaattctttcgcacctttttcaagaagttttttagcagtatctacatcgtgatctttgaagtagccagttttgttatcagtgaatccttccattgttggtggaacgattgccatagctggaacttgttcaccttgcgtaattttgtcaacgatcgcttggcggttgattgagtatgcaagggccttacggatgtttgcattgtttaaaggttttacttctgtgttgaatttgtagttataaataccagcgatcgtttggattttcagaccgccttcttttttcaatgtttttaaagactcagttggaaggcttccagttggtgaaccagcccagtcaagctcgccttttttgaacatgctaagctcagtgtttgtatctttgatcatagacatgttgatttttttcaatttcacagtatctttatcccagtattcattgttcttttcaagcgtgatagaaccgccatgtttccatttagaaagaacgaatggtccgttagatacgtagttttcacctgcatttgtgtaccagtttttattcttttcagccacttttttgttgactggcatatacgtatagaatgcagttagttcagtaaagaacggtgttgggttctctaactcaacgacaagcgtctttttgtcttttgctttaatgccaacatcagcaactttcgctttccctttgttcgcttcttcagcacctttaatatagtaaagctggtaagcatattgagattcatttttaggatctaatgcccatttccaagcatattcgaaatcttcagctgtgacagggtcaccattagaccattttgcatcacgaagtgtgaatgtgtatgttttaccatcagcacttgttttgatatcagaagccattgcattttctggcttaccttcagcgttaattcttgttaatccctcaaaagtctgacggatgacacttcctgaagttgaatcatttgccaatcccggatgtagagaaaaaggctcagtggagatattcacatttagtgttgttttagcctctccagaactgctcgtgctgtcgcctgatttgtttccgctgaaaccacaagcgcttaatacaagtgtgaaaataagcattaaagtaacaacagaccaacgctttttcaactgtattcccccttataatatgttttagttcaaaggtctcgatagaagatgagattcagatttaagaaatagcgtaaaaaagtccctaaatagcttactttctatttcttttgttttttctgaattttcactatgtaaagagcctagcacaaacgtgtgaacaaattaattataatgaatagaataatttattgcaatatcaatttcatatatttttaaaaaacgtaaatggggataaagagggatttttataaactaaagtctcaatcacttcaacaaattaaagcggaaattgattaaaataatttaacaaattcagcaggaataatgttttatacatataattaatcatccctttttaaaaaattgtgacagatagttggtattttacctaaaattttaagtgtcaaacgacatgatgagaaggtcacataaggggcttcgtgacttttttatggtcatcctttataatagatagacatactgttgcgatgaaaaagaagagtacatatattcaccattaacagagagtctgcggccggtgcgagcagacaatggcatatatggaatgggctttggagcagctaaccgaacacttttgaaagtaagtaggcttagacggagcagtctccgatatcaacgtcttgagtgatttccatgtgaaataacaagggtggtaccacggttcattcgtcccttttctgttgaaaagtgacgggtgggcctttttatattgaggaaaagaggttttagtatgacaaagaagacgattttttcaggcattcagccgagcggttctgtgacattggggaactatattggagcgatgaagcaatttgtcgatctccagcatgattataatggctacttttgtgtagtcgatcagcatgccatcacggtgaatcaggatcgtttagcccttcgacaaaatattagaagcttagcagctctttatttagcagtgggacttgatcctgagaaggcgacattgtttatccaatcagaggtacctgctcacgcccaggctggatggatgcttcaatgtgttgcttatattggggaattagagagaatgacccaatttaaggataaatccgctggtaaggaagcggttgtttcaggactattaacgtatcctccattaatggctggcgatatcttattatatggtactgatttagttcctgtcggagaagatcaaaaacagcatcttgaattgactagaacgcttgctgaacgttttaaccgaaaatacaatgacatcttcactgtacctgaagtgaagattccaaaagaaggcgctcggattatgtctttagcagatccaacgaaaaagatgagcaaatccgatccgaaccaaaaatccttcattactttattagatgaaccaaagcagcttgaaaagaaaatcaaaagtgctgtgacggattcagaaggcatcgttaagtatgacaaagagaacaagcctggaattgccaacttgctgacgatttactctgtattaggtaacatatcgattgcagagcttgagcaaaagtatgaaggcaaagggtatggtgagtttaagggagatcttgcgaacgtcgtcattgatgctttaaaaccaattcaagatcgatacaatgaactcattgagtcagacgagcttgatcgtattcttgacgaaggtgctgaaaaagcaaaccgcgaagcaaataaaatgctgaaaaaaatggagaatgcaatgggtcttggcagaaaacgcaaataaaaaaggcttgcagcacatcacgctgcaagctttttctaattcacctttgattcgttttccatttcccaaagcttttcaaaaaacggctgtcccttaatcattttttcacaaaatgttaaatgattttctgaccatccatcaatggtttcattgtaaagcatgttccaaatctcttcgaatgacattcgtttgatttgattgtacatgcgagggttccattccgtataccaatacgcaatctccgccctgttttgaagaccttttaattgatcgagcgccataaacatgagctgcttcaactgtctttcttttctcgttaatccacagatatgctgcggcggcaaagacaaaatatgatactccttcgctgactcaagactgtcctgagagaattcatattcctcagccctcacatctttcaccatttcatacaccaattgctcctgccttgggattaagcggcttttcctcacaggaatggaatacccaatcgtatccacagcaataattcgtataccgtccgtcaccacaaaacaatactctaatttgcgccgttcatgattttttcgaatatatgatttctcaaatactgcttctagcagcgtctttggcagttctgaaagatcattctctatgtaatcatacaaaggactctgcaccttgagtaaaggtacttgatctaacagctccacgctgtcctccttacgccactcatgaaaatgacacacattgtagccattttcttccccttcaaaccaattcacccatacgtcatgaagaaataacataaccaatccctcactttataaaaactgttgtccacagtatgggcaagagatagagaaattattccaactttattaaacttcaagctgagtgaatgatggcatgcttttctttatgacataaagaaaagaaagggtgtcgcagagtccctttcatcttgtcatacaaatgaggcattactttaactttttaggatcaagtgcatctctcagcccatctcctaagaaattaaagcataaaacggtcagtagaatcagtaaacctggaaacaatggataccaccacgcctgcaccataatcgagaaattttgtgcatcttgcagcatgttgccccagctcgccgttggcggctgtatgccaaaccctagatagctcagcgttgattcggctaaaatgacggaacctacttttagtgtagctgacacaataataggaccgatacagttcggtaaaatatgcgaaaagatgatgacatggtttttcgttccaatggttcttgctgcgagtacgaattctcttgttcgcagtgataaaaattcactgcggattagtctcgcggttgtggtccatccggtcaaagcaaagattaaaatcaatttatcaatacccggtttgaaaatggtaacgagcgtgatcaagagaaaaatatcgggaatcgacaacacgacatccacaaatctcattaacaaggaatcaacaaatcctttgaaataccctgctaccgctcctaccacagtgccaatggtaatcgcaccgaccaccgagacgaaaccgactaataaagagaccctcgcgccatatagcacccttgagaaaatatcgcggccaaacttgtcagttcccatcaaatgctcagcacttggcggctggagccgttttaataaatcttgctgctctggtgcgtaaggggcaatcactggagcgaaaatggctgaaaagataatgaccaataagatcacggagccggcaaccgccaatttatttttgaaaaacttctcacaaaataaacgcagcatcgtctctggctttggcggaagaccctcctttaatttgagatcaacaggaggtgttcccatattaggctgtgccaactgtgcttcagctcccttctaatattcaatacgcggatcaacgatcgcatagagaatatccgcaattaaatttccaaccaccacgagcactgcggaaataacagtcatcgccataatgaccggataatctctcgaaaaagcagaatcaataaacagcttccctagccctggccaagtgaaaatttgctccaccacgactgcaccaccaataaaggatggaatcatcaatccgaaaatcgtaatgacaggcataagaccgtttcttaacccgtgcttgaaaatgaccttgttttctcgaaagcctttcgctcttgcggtacgaatgtaatcctgcctcatgacatcaagcatactcgaccttgtgtaccgagtgagccctgccatatcagccgttgctaaaacaaaggctggtaaaatgatgtgatggagccggtcaaacacattaaaatcggcattcaaggtagagactccgccagttggaaaccatcctaaattcacagataaaaccataatgaggatgagtccaaaccaaaagttcggaatagccagtccgataaaagatgtaactgtaatgccatagtctagctttgtatatggacgttttgctgaaagaacaccgaatgggatggcgatgatcaaggcaactaatgtagaaaagatcatgaggatgagggtatttggcagccttgcaaaaatcaaatcagccacaggcgttccctttttaacaatggaggtgccaaaatcaccttgaagcatattgccaagccatttcatatattgcacatattcaggatcgttcaagccgtacttatcaataaaagcttcccggtctgccgcactaatggttgggtccatcataagtgacatcggatcgcctggtgctgctttcatgatggcgaaggacaaaatggtaatcccaaataagatgggaatggaaagcaatgtccttctaatgatatatgtaaccatatgcacaactcctttttcatcggatcgccatactgtgatgaaaaagggctaaaatgatctttcttttagccctctgtcttcattgcatcgtgatatgaaaaccctctcaatctaactggtgcacggtgaataaaattgtgagcgccagcacgcctgattgacaccgaatgaaagggatctgagagaactttcctcttctttcactagcagcctactgttcaatccaccatttctcgattttgtaatactcatctttcgggtggtatgagtagccttggagattagatggcatcgcgcgatgtgagttggcatagtaaaggaacgtatatggttgatcctctgcgatcagttcataaattttttcatatgcctttgagtattcttttcgatcacttaaattcttggcatctactaacagcttatcgacctctttatttttataccaaatgttattcaagcctttttctgactggcttgagtggaagatgctgtattgatcagggaatgtcgcaaggctccagccgagcagcagcgcatcataatcccatttaggcggtgtcgtctgttcaatgagtgcgctgaattccacaatttgtggcttcgcttccacaccaatttccttgagctgctgctggacaacgacagcaatgtcttcacggactttgtttccttggttggtctttatgacaaaggagaattttttgccatccttatcaagatagccatctccatctgtatcctcccagccctcttctttcagcatctttttcgctttttcttgatcaaactcaaatactggaacacgatcagtctttggatagttccatgacagtggactttctggaatgttggctactttgccgtctccatccaacacttgatcgacaatcgtttggcggtcaatggcatgtgtcagcgcctggcggacctttttacttttgaagagttcatttttctggttccagccaatgtatgaataattgagtccgagatcagattcaattttaatgttgctgactttttcggctgtttgcagctcagatcccggtaccgcaaagaaatcaatatcacctgctgaaagctgggcgattgctgcgttctgatcaggaatggttttaatcgtgacggtatcaagatatggacgcccatcccaataatcgtcaaaggcttctagtttcacgtagtcgccttctttccactcggcaaatttaaatggaccagaaccaattggtttttttcggttaaattcattttcaccgagatcctttataggcacatcacctaaaatatgcttaggtaaaatgccgtagcttcctagtgtgacattataaaaataaggatcttttttattgagcttgaattcgattgagtaatcccctgtctttttaacagaatctaatacttcaaagcctgatccgcgctccccgttgtagtccttattgatcggaatgctgtatgtaaacacaacatcatcagctgtcagttcttctccatcatgaaactttacgccttttctaatggtcacatcaaactgcttgccgtcattagattctttaatatcttctgcgagtgatagctgagggttcagctttccgtcagtttgaagtaaaaagctgtagattctttcttcaatatctgagctagccacatctgttgaataaagcgagttaaataatgttggttctgcaatggaaccgatgacaagatctccgccctgcacaggtttaccggtggatttcttttcactgtctccagaggttttatttccactagagcaagccgcaagcatgagcgtgaagatcagcagtaaactgaacaatatagattttctatttctacctttcatatacaattccccctatccttttttaaaaatgacgacagatgccgcttcatcccccctctcaaagatgaattcatccaagccgattaagcgtcgtagaggtgacaggcaacgaagtggtttggttttaattcttgaaatgctggtattttttctttacagatttgtttcgcatgcgggcatcttgtatgaaatacgcacccttttggcggatttgcaggacttggcagatcgccttgaagcatgatccgttctcttttgatctgaccttttttacgggtaacagggacagaagaaagcaatgcctgtgtatatgggtggagcggttcatcgtacaagctgtgcttatcggcaagctccatcattttaccgagatacatcacgccgactcgatcactaatatgcctgaccacacttaagtcgtgagagataaatagatatgtcaggtcaaattcctcctgaagttcctccatcagattaatcacctgcgcctgaatggatacatcaagtgctgaaaccggctcatctgcgatgatcatttcgggattcatggcaagcgcacgagcaatgccgattcgctgcctctgcccgccagaaaattcgtgaggatagcgatttgcaaagcttggatgaaggcccacctttgataaaagctgttctactttttcatttctttcttttaaggaatataagtggtgtgttttgtagggttctttgatgatgcttcgaagtgtttttctagggttgagtgatgcaaagggatcttgaaaaaccatttggatgttttttcgcgttgattgtcttagctttgattctgatacgcgggagatatcttgccctttaaaaaggatttgaccgtcagttggctcatataaacgaatcatggtccggcccaatgtcgatttaccacatcctgattcccccactatccctaacgtttcacctttataaatcttcaaatctacgccgtcaacagctttgactgcaccgactttcttctgaaagacgcctgctttaatcggaaaatgttttttaatctgtttcagttcaagaatggtttctttctctattagatctgttgcatttggctgattttgagcaagggtcatgttcggtctgcctcctcatataagaagcatctgacgcttctgccattttcaaaagtcctcagcttaggcagttcgcctaggcatcgctccttcacttgcgggcatctaggagcaaagcggcagccggctggaagctgatctggcgcagggacattcccttttatcgcagttaacggctgtatatctccgtcaatgacaggaatcgattcaagcagcccttctgtgtaaggatgaagcggctgatcaaataattcttcgacggtcccattttcaacaacctgtccgcagtacatgacaatgactcgatctgccacttcagacacgacacctagatcatgcgtaatgaggagaatcgatgtaccaaatgtcgtgcataaatctttcatcaatgtgagcacctgtgcttgaatcgtaacatctagggcagttgtcggttcgtctgcaatgagaagtttcgggtcacagcttagcgcaatggcaatcatcactctttgccgcatgccgcctgataaacggtgcggataatctttgatgatttgttccggtctggaaaaaccaacaagcttcagcaggtcaatcgcttttttcgtcgcttctttttttgaaagttttttgtgatagatgaggatttctgttatttgttccccgatagttaggacgggattaagtgaggtcatgggctcctgaaagatcatcgatacgtcattaccacgaatgctgcataattccttttcaccatatgtaacgagatccttaccatttagcttgatggaaccgtccataatttttccaccagtgccgttaatcaagcccataatggataaggacgtaatgcttttaccagatccagactcaccgactaatgcaacagtttctcctttgttgatgctgaaatcaacgccatctacagcaggtatcgcttctttttttcgaaaaaaataggtttttaagttctgcacttcaagcagtgtggtcatttattcgcccctttcaccatcaattaatagaaatggatctaaaattcagccttttttgaataaaaagaattatcaaaatttatatttgtatattattacattgttatgacgaaatcaagaaaaatttagtaaatttgtaatatgtctctttttatgtgaatcattcactttgtgagtctatcgcctttaaaaaagtttcggacggctctgcaatcatagactcctcgctgattctgtgttcactgaaatattttttcacgatataaaatccagtggcataaccaagcattttggggtagttcccttttccataaaggaggttctgtatcagtctttcgtcgtcctgcactttttgatcaagatgactggatacccatttctggtacatacgctgaagctgcgtttcgtcatagagagtggtccatttggctgtatagctttctccgtatctatgatacacagcatattcagcgagcccctccatcatgattgtatcaaggaatgtaaaatctttttcttctttcgtgagaaaatgcaacctgcatacatggtgatattcatgagtcagcaatgttccgatacgttctttcggggtatttggcgacaaaaagagaaagaccttgtcgtcaaatgccatgccggattgataataaaattgctctctaatttctttgctgctctcattgactggcaaaataaagactggaatgtcagggcctttccactgcttttggagcgcccggtattctttcatgacgagctggaagtaccctttttctttgagcttgtcgatcatgtctatgcatgatctaaaagaccgaatcatgccgtgatgctgcaggtgggagagaatagaggaccattctttttcctccgcccctttaaaataaggaacaaagcgcgacgcaagctcctgaaatgatgaagattgatgaatgagatattgtgtattgactagacccatactgctaaacacctccattttcatcatatgcaaaaaagcggcgatctgtttatagatcgccgcctcttaggaaatattatgcttcgtattttttaaagataattgtcgcattatgtccgccaaagccaagtgagttacttagagccacttgtacttcttttgaacgtgcttcatttgccacataatcaagatcacattcttcatccggtgtttcaaggttaatggttggaggaatgacgctgtctttaattgcaagtacagagaaaatagcttctactccgcctgctgcgccaagtaagtgacctgtcatcgattttgtcgaactgatcgcaagctgattcgcatgctctccgaacacttctttaatcgccattgtttcaaacttatcattgtacggtgtgcttgttccgtgggcattgatataatcaatttcttccacagacaaaccagcatctcgaatcgcttctttcattgcgcggacgccgccttctccgtttggagccggtgctgtaatatgatacgcatctccagttgatccatatccaacgatttctgcataaatcgtcgcgccacgttttaatgcatgctcaagttcttcaagaacgacaatccctgcaccctcacccataacaaatccgtcacggtttttatcaaatggacggcttgctgtctctggatcaggatttgtcgaaagcgctttgttcgcacagaaaccagcaaacgacatttttgttaacggcgcttctgttccgcctgtgatcatcgcatctgcatctccgcgctgaatgactttaaatgcatcaccaattgagtttgtacctgttgcacatgctgttacagtacaagagttaactccttttgcgccaagtgcaattgaaatttggcctgttgccatatctggaatcatcattggaacgaagaacgggcttacgcgtcttgcccctttatttgaatacacttcaaactgctcttcaaatgtttcaagtccgccaataccagatccaacccatacaccaacacgcggtgcgatttcatctgtgatttcaagacgtgaatcttctaaagccttttgagcagcaacaactgcatattgcgtgaagcgtgccatttttcgtgcttcttttttctccatgtaatcttcaatgttaaaatcttttaattctgcagccacttttgctgtatattcacttgagtcgacacgtgtgattggtccaactcctgatacacctgctaaagcatttttccatgttgattctacatcgttgccaagaggtgtcaaagcacccaaccctgtaacaactactcgttttttatccattaatttgtgcacctcactcttttatcggccccatcgcatagcgattgcgccccacgttaatccgccaccaaaacctaccattacaatcacatcgccgtcatgaatttttccggcttcgatttcttcacatagtgaaattggaatagatgctgctgatgtgtttccatatttatggactgtcttcgacattttttcaactggcagctctaggcgttcgcgggctgcttccataatgcgaatatttgcttgatgcggaatcaagaagtcaacgtcttcttttgatagtccagctttttcgatgacgtttacgcttgactcgcccatttgtcttacagcaaatttaaatacttctcgtccattcatgattgtatgatctttttcatctaagtacaagtgcttaccgcctcttccgtcggctccaagctcaaatgagagaattcctttcccttcgctgacctctcctaacacagcagcacctgctccatctccaaacagaacagcagtattgcggtcatcccagtcggtaatacgagaaagtttttcaacgccaacgacgagcacgtgcttgaacgtacctgattcgataaattgttttccagtaacaagcccatacataaagccagcacacgcagcgctaatatccattgcacatgctttatgtgcaccgagctgctcttgaatcatacaagcgactgtcggaaatgcttgatctggcgtgactgttgccacaagaatcatatcgatatcttctgcagctacatctgcgtcagctaatgctttttttgcagcagcaagcgccatatgtgatgtattgacatcatcagaagcaattcttctttcttctatacctgttctagtacgaatccattcgtcagaagtttcaaccattttttctaaatcaagatttgttaacactttttcaggtatgtagcggccaaggccaataattccagcattcattgaataagactccttttactcatacgagcatgtgatattgtgatcttatattagtatctggtactaattttaccttatttttttctccttggcaatacaaacgtctaacctttcctctcacttttttcatagattattgatatatcgatagtagaaaggagcatttgatatggcacaaaaagatattttttcggcgatgatgtttggacagccgcttgaaaaggagaaaggcaagacagaagcaaaggaggaacgagcagaaacaacttcaagtgaagactccattgactacatgcatgtcatgaatcaaattgggaacattatgaactccatcgatgaattgaagcctgtgtttaaagatgttgggcctatgattagtgccttcaaaaaaaaattatcataaaaaaaagccactattctgtggcttttcctgattctgcatctgcttttccaagctcatatgcctcttgcatgacagatgtaaacaatgataaaagcggctgaagagcttcgggctcaagctgaatacctgctttatctaattcttcttttgcctgaggaaaatacttcatggcaatttgtaaaaactccatcgatttttcttgctgcatcgtcgtatcctcacttttcatttggcagtttgccagtttttttgtaagtcgcaatatcactttcaatgtctttcaaaaaagcacggtcaatggtagaactaaatttccccatttcgatcactccttctttaaagtcaaaggagtactcaccttgtgcatttagcttgccttcattaaatttcttcgcaataataccgtacgctttatccacatgctggactgtgcttgttaaaacggtatggctgccgaggttggattgatcggtgacatatccgatcgctgataaattatcggctttgatttgttcaatgacagggatattataaccatcacctgctggatatacaacatctacgccttgttttttcaatttttgatagagctccacggctttgtccgcatcatcccagttttcgacaaactcagcaagcacttgtacatgttcatcttgatattttgcacctttgataaagccgtctacttcgctttgccaatcatatgtagcaagaataccaatcttttttgattttgacatatgtgctgctgtcatgcctccgaaaaagcccatcgcttcacctttaaacgtcacattcgcaacattatccgcctgaggcttgtttccatttaccgtgataaattgtgttttcggataatcttcactgattaaattgaaaatttcgctgtattcattgccatggccaataatcaaattgactccttttttgtgaaattcttcaatggcatcaacgattttctctttgtcgaccattccttccttataataaacatctacaccaaatgttgattgaatatttaataagcctttataacctttcgttccccaaacttgatcattaatagtatcggggacgagtaaacccaccttctcaatctgtccttttaaaggtgcctgtgagcaggcagataataggagaaggaacgaaaagatcatgacaagccgctgatacttcatgccatgttcaactccctttgccacatgcaggcatgaacctgtatgttaaatataggtttattttatactgaaaaaagataagatggaagatcattcttgctttttgtcgaaaaatgttgagttttgtcttttccattctgctatcatttcttctgcttgtttgtcatctatttgtctttctaccttcaattcatgtgtcatttcctgtctttgttcagagcccgatgcccacttgaacaaatccctagctacatcttctacaaaaaatgcttcttcacgcttcgttctttcttcatcaagtgtccatggtccaaacatgcgcggtagaataactgccggcacattctggttggatgatttgtcttcggttttttcgtaaagaacacggtacatgccatgcgccgctttcaagtcttcctgtcttttatctgattcatctgattgaataaagatcagatcatacgtgtcttttccatcctgaaggtcaatgacacggaaaagatcatttctgccaagccacatcattcgttcttctaataacatcttttgctcttctgtttgatcatgaggacatgtgatgtccacttgaatgccctctttcatcatatattcacacagcgctaggccaaaaaattcatctgcccctatgatcagtcctgtctccatgttcatgtccccttttttagcttatcgaataaaaagaagagccctttccatgaagggctgttatcatcctattcatcacaattctttttcatgcgatttataaaacttgtgaatggattgaaagattcttctcggatgatcaaacatatgcaaggtgagatcgatctgacaatgctctggattcttcatgtgctgatcaataaaaggctttgcatgcagttcatatgcatagggtgcaccgtttagtctttgccatatgtgaattggtacatgagcagaatgaacagggcaagccgggagctgatacgtttccgcttccttttcagaacagccgtagctcttcgctaattctttgattagctgtttataaaagaatttgtgttccttttctctttctcgttgtgcatggagatgcagacatggattcaccagtgcaatggatcttagcacttctggcatctcttctgcaagactcatagcaacgagtgcgcccatcccctctgccagcacatgaatttctcggtttaatatttcttgttttaatgtgtgatgaacgagctgctttgcactaaaaacagcatcttcgcatccccagtgattcccatgaagatgactattaaacaatgtatatccttcatcctttaaggcagttaaaagctggtttcttccatagtgctgaagccagaatgatgtattttcctgcacaaagtgatttcggtcaccgaggataagaatgccaaagccatttggtttttgaggaaggtgaatgacgttccactgggaaccaagctggaaaaaccgttcgcttacacccatatggccagcctcctttcagtgattctgctttctatgatatgaacaacaactcttgtaggaataaggaaatcccctaatgacagaagaattctttttatttttatagcagaaggtctaaaaatggtcacataaaggctaaaacagtcttttcccctcactcgtatctatggtatgataatcaatagattgttacataaaggacggtgggattatgcattatattatcaccctcatttggacttttctgctgacacatatggctggttacatcgttgcttcgatgaatggcgctgcttatgactttactttgacttctattcttgcagtggtgtttacggttattttattcatctttgctgaagtaagtccaatgaaagaaacggaaagttcaacaaaacactcttaatacgtaagagatgaatgtgagaaagagctaaaatgatcttgtttttagctctttttctttttatgaaaagaggtacgctaaaaccccctgcagccacagggggtttttttattgcctacacctcgacggtttcggacttctgtttgtctgctgtcaaatggcttttcgcaagccctgtaaacaggaagattgcgatacctgataaaatttcaaggaccccaccaccagcaatgacaggtcccgctccaaatctttctgccaggacgcctgatacgacagctgcaagcgggaggaaaacatttgatgaagcattgatcactgcgtatacttgcggctgatcatcttggtcgacagacgtttgaataatgaccatttcaggtacattgatcgcactaacggcggcaccgaatataaaggaagcaagtaaaacgaccggcagccatgtactcatccctgtgataaagaatgcagccccttcaatcataccagcgacaataaagaacaaaccaaatctcttaattttcactttcgctagagcaaagcccatcataaaggcacctactgcagcaactcctcttaaaatggaatacaccatggaatcgctttgcaatgcttctgctacatatacagcagaaagtgcctgccacggagctgcggcgacattcattaaaatacaatacaacgtcagcgcaaataaaatatgatgatttttaacgacgagaaaccctctttttaagttatacaaatatgtattctttgcttgtttaatgcctgctgctttgtcttcatcggttttctttaatttaacgccgataataaacaggccggatatgataaataaggcagtggtgataagcagggtatctgcaggtccgattaatttgactaagagaccagccaccatgactgctgcaagtgcaacaatttcaaaagaagattgcaggatggcgtttgctttttgaatcagatgcttcggtacaatctgaggtaaaatcgccacagaagctgggttatacgctgcaccagttgccgattgaataaccattaatgagatcaataaccataaaggcaatagatgcgaaaaatgcagtagcggaataatgagtacaatggttgctcgaacgacgtctgaagcgaacatccatttagacaaatggtgctttttcataagaggtcctagtattggggctagcaaagatgaaggaagtacggttactgctaggagaagtcctgtaccgagcgctccatcccctctcaaaatcaatagccaaaggacggatgtaaaagcaaaactttctcctgtgtttttaatgagtcttgatatgaataatgaggtgaagcgtttattccaaacactttcactgagattcgtcttttccatcacacaaatcctttcaacaatatattacaattacatattttaccttatcttctcttttattcatactatttatttgaaaatttgaacttaattgttttttattataaagaaaaaagaggcatgacacatgcctctaaagacttattccaaccgactcttagtcaattgcttacggctttctctgataggtccaaacacggttatggtttgagttatccggaaagacgtcgcctgcttgaagcttaatctttaaaggatctttcaccatactgccggtttcaccgatctcgacatacacaccattatttggtgctttattccctgatttaaactgatgctgctgacccatttccatcctcctttctcgatgatgttattatgtcccgtgacttgcctctccaatcctttatgcaaaaagtccctgctcctacgagtcagggatgcttttcatttatttggtttgttgatacatgagctctttgattaatgctttttgtacatgcaggcggttttctgcctgctgaaatacttttgagtgcggtccgtcaataatgtctgctgtcacttcttctccgcggtgtgctgggagacaatgaaggaaaatataatcttttgctgcatgacgcattagttcatcattgacttgatattctttaaattcagcaaggcgtttctctgtttctgcttcctgtcccatgcttgtaaacacatcagaataaatgacatctgcattttggacagcagcgacaggatctgtcgtaacgatgacttctgcgcctgattgttttgcaaactcacgtgctgtgtctgttacttcttgaagtggttcatagcctttcggagatgcaactgcaatatcacagcctagctgcgcacagccaaccatcaaggagtgcgccacattatttccgtcaccgatgtaggcgactttgattccttttaatgttccttttgcttcttttattgtcaataaatcagcaagtgcctggcatggatgggagtagtcagtcagcccattgatgacaggaatggacgcatattgtgccagctcctcgactttctcatgttcaaaggttcgaatcataatgccgtctacatagccagacagcacctgcgctgtatcactgatcgtttctcctctgccgatttgcaaatcatttgagctgaggaagagcgcatgtcccccaagctgcgtcattcccgcttcaaatgatacacgggttctagttgacgatttttcaaaaatcatcgctaatgttttccctttgaataaatcttggtatgggttttgtttcatttcttccgctttttcaattaaataagcaatgtcattgattgagaaatcttttaatgataaaaagtcttttccgtataatgtcggttgcaggtcaacttgactcatgccgtcacttcctttttgtataattcttggagcgatactggtgatacatctccatttttcccttgcaggaatgcttgaacggtttcatattcggttagaacttggacgccatgtgtgagtgcttttacgcgttgctcttttgcctcttcatcttcgcctaaatggatatgaagggatttatcttcgttttgcagccaagtgtcaaagctgtccgtccagacatcaaaacctgcatgttttgcttcatctaccaattgttcactgccttttataaataagctgcctttctgatgccagattgacgcaaacacttttttcaaggcgctttccgcgttcttacctacacacattccttctcctgtcgctttcatttcaggtgtcagctttaagtcaatatcttgaatggcatgtgatgagaaaactgggaatttgaccgctgtgccccctttgtttttcgttactgggttcagttcttgaagcgttgcacccgctaataattgagtcgcaagcggaatcatgtcaatgcccattaccttgctgacaactggaacggtccggcttgccctcgggttcacttctagtacaagcgcctgatcccctttgatcacaaattggatattcataatgcccttaaacgctaatttattcgctatttgctcggacgcagtatgcacctgctgtttgatgtcttcactgattgagacacttggtaggatggcaaagctgtcacctgaatggacgcccgctttctcaatatgctcgacgatcgttggaatgaaggtcgtttttccgtcagaaatcagatccacttcaacttcttttccagtgacatactcatcaattaaaattgggtatggcaaatgatctggctgatcaagtagtgacgtcaaatgcgcttctgactggacaaccatcattcccattccgccaatgacatacgatgggcgaattaacacagggtaaccgatgcttttagcatgcgtgagtgcttcttctttagaatgagctgtatctccttttgcatgaggaaggttcagttcatcaagaagctgatagaacagatcacgatcttccagcgcatctagcgtgtcaaaagatgtacctaacaacgtaatgcccgctttttctaagccttctgctacattgatggcagtctgtccgccaaattgaacgatcacaaaatcaatttgctctgcttccacaacgtttaagatgtgctctaatgtaatgggctcaaaatataaacgatctgcaatttcataatccgtactgaccgtctcgggattgttgttcatcatgatggtttcaaagccaagcttttgcagggtaagaacgccatgcaccgcactataatcaaactcgactccttgcccaattcgaattggaccagagccaatgataagtgcacgctgttttgttttctcttgatgctctccatcacttttaccaaagtatgtggaatagaaatagttcgtttttgcatcaaattccgctgcacatgtgtcgacaattttaaatgaagccgtaatgccatattcttgacgaagctgtctaatagcttcttcactattgcctgttagaagagcaatcgtttcatcaaggaaccccttttcctttacctttttcaaggtgtctttagagagcgttccatcatggttcttcaattcctgttcgagcgtgatcatattgttgaacacatgtaagaagaatagatcgattttcgtcgcttgatggatcgcttcaaccgtttcctttcttgaaagaagctccataacagcgaagaaacgtcgatcgtctggtgttttgacaagctcaaatagttgttcagtcgattgacctttcaattctggcaggtggaagccctttgttttaatttcaagggaggcaacggctttttggatggctgactctaaattacggtcaatcgccatgacttcgcccgtcgctttcatttttgtacctaattgacgatctgcctgtttaaatttatcaaacggccagcgcgggaatttcacgacgacataatcgagtgccggctcaaaactagcataagttgtgcctgtaagcgggtttttgagttcgtctagtgtatagcctaccgcaagctttgctgccattttagcaatcggatagcccgttgcttttgaggcaagagcggatgaacggctaacccgcggattcacctctatgacaaagtattctttactaagcggatcaagggcgaattggatattacatccaccgactacatcgagtgctgaaatgattttcaggctcgctgaacgaagcatttggtaatcccgatccgttaatgtttgcgaaggtgcaacgacaattgagtctcctgtatgcacaccaactggatcgatattttccatattacaaaccgtgatacacgtattttgacggtctctcatgacctcatattccacttctttaaagcccgcgatgcttttttcaactaaacactgatgaatcgggctcgctaaaagggctccttcaataagtggtttaaacgcttcttctgttaaagcgattccgccgcccttaccgccaagtgtgtatgctggtcttagaatgactgggaagcctacttcttttgcaaattgaagggcatcctttgcattatccacaatttcactatctggtacaggttcgttcaactgcttcatgagagcacggaatttctctcgatcttcaccgttttcaattgtttcaactgacgttccgagcagggttactccgtgctttttcagcacaccggctttttctagctcgacagcaaggtttaaagcggtctgtccgccaaggttggctaaaagaccatctggtttttccttttcgatgattcttgtcactgaatcaactgaaagcggttcaaaatagatttcatcagcaaatgattcgtctgtcataatggttgctgggttgttattcactaaaatcactttgtagccctcttcttttagggccatacatccttgtgttcctgagtaatcaaattctgctgcctgaccaatgatgattggaccagacccgatgactagaatggtttgtatgctttgatctttaggcatgtgcgacttctctccttgcttgtttcactttctcaataaaatcatcgaatacccattcactttcagcaggccctgggtgtgcttctggatgaaattgaactgacataatgagcttctctttatgaatgaatccttcaacagatccatcattaacatgaaggaatttcacgtccacttctttgtcattcatgcttttttcattcaccacatagctgtgattctgacttgtcatgaacacacgtttggattctgtatcttgtacaggatgattcgccccgcggtggccaaatggaagtttatacgtatccccgccaagtgcaagagcgattaattgatgacctaagcagatcccaagtgtcgggaaggtcatcatgatctcatgaatggtttttaaatatggcttcaatgttttgggatctccaggtccatttgatagcaggaccgcatctggcttcatttcaaacaccttttccagctgtttgtacggaatgacggttactttacagccgcgcgcttcaagcgaatctgctattgattttttaaagccaaaatcaataagcgctacatgttcctcgccgctgccttgagtgtagatatcatcgtctgtcacctgtgcaaccacattgtcttttttcatggccggcggtgtttcattttcgtctacactgatcacagcgttcatcgtcccatttgcccgaatgttttgcacgactgcacgtgtatctgtatgtgtcagaagcgggatgttccacttctgtaaataatcttttaagctaaccgcagcaagatggtgagagaaatgatcggctgcttcatacacaacgaccgctttcacttgtggttttttgctctcaaagtcttcatgattaatgccgtaatttccgatgagtggatatgtgaaaacaatgatttgtcccttataggaaggatctgtgagtacctcttggtaacctgtcatccctgtaaagaaaaccacttcacctgtcttgccagcttctcctgtcagatctccttcaaaagaggctccatcttctaaatttaaataacctttcatgcttgtgtcaccccaaattgaataattagtaatataaatgcatttttatgcgttttggtgtaaaaaaatttataccgtcactgtttcatttgctaaaacatgagtaatcgcttttattgcttgatctatttctgctgtttctacattcagcggaggcaataaccgaatcacattcggaccagctggaagtactagcaatccttgttctctcaaagctgtgatataatcccccactggctgatgacattcaatccctgtcatcaatccttttccgcgtacttcttttacgatattcagttgtttcagatcttgcagcttttctaacagataagcgcctttttctttcacttctgtcagaaactcatctttgaaaatgacatcgagtgttgcattcactgctgccatggcaagcatgttgccaccgaaggttgttccgtgtgaacctggtgagaatgcgtctcctaaagcctttttcccgatgattgcaccgactgggaagccattccctaatccttttgcagaagagataatatcaggatcaagtcccgtttgttcgtatgcaaatgctgttcctgtacgtcctatacccgtttgaatctcatctacgatcagaagtgcttcatgcttttggcaaaacgcttgaacagcttctagaaattctgttgtcgctggatttacgccaccttctccttgcacaacctcgagcatcaccgctgccacattatcgacttcacatgcggcaatcgcttctggatcattaaacggtacataatgaaagccttccagcatggggccaaaacccgttttgattttatcttgacctgtagcagccataccagcatacgtacgcccatgaaaagagtgcaaaaatgtcacgatgtttgttttccctgttgctttacgcgctaatttgatcgcaccttcatttgcctcagctccgctattacagaaaaacacgagatcccctgaactgtttgcagctagtttttctgctgctttttcttgtagtccattttcaaatagattcgatacatgccagacgtgatcaagctgtttcttgatggcttgattgacctttgggtgattgtgaccgagatttgtgactgctatgccttgtataaagtctaaatattttttcccatttgtatcgactgcccaagaacctgctgcctctttaatttcaatattccaccgtccatatgtttgaaagagatgactcacaggaccgcctccttttccttcacaattcttgttcctttaaaggtttcccctgtaaagatactgcctttgccattgacgatcatgacttcatccacatctcctgatagagcattcaaagcggattgtacttttggaatcattcccccggaaataatgccttcatcaatgagcgtgagagcttcttgttcggtgacaacatctaataattcaccattttttaaaatgccttcgacatctgtcacaaacatgagcttatcagctttcatcgctcctgcgacagcggatgctgctaaatcagcgtttacgtttaacgtttggcattcttctgtcatagacagtggtgcaatcacaggaataaattgtttctccattaatgcttctgccatttctggatggacttctttgatttcaccaacgtacccgtacacgtcttgatcaagaaaatcagcgacaagcatccgtccatctttgccagacacgccaacagatgagatatcatgctttgcgagctctgatacaaagtatttattgaccgttcctgaaaggaccatttcggctacctctaatactggcttcgttgttttgcgctgcccgtcaacaaattctgttttcacttctaatttttgaagcatgttcgtgatttcagggcctccgccatggacgatagccagcttaaacccagcagcttgaagtgagcggacattttcgtaaaaggtatctgaaagttctcgaatgacactgccgccacacttgaatacgatcgttttatccatgtctatctccttcattatgtgcgatagctcgcgttaattttcacataatcataagtaaggtcacagccccatgccgctgcttcaccatttccctcattcatttgaattaaaatcgtgatctcatcctgctctagatacgcttttgcttcctcttcagagaatggctgcggttcattatgtttaaacagacattgcccgcctaaatacacttctacctcttgtggtgtgactgacgctgcgctatggccaatcgctccgatgatacgcccccagttggcgtcggtgccatatacggctgttttcactagacttgaaccgacgattttcttcgctatgatgccggcttctaaatgatttttagcaccagtgacttgcgcttcaattaatttcgttgcaccttctccgtctctagcaatatctttggcaagatcctcacaagctagctttaatccttccttgaacaatggccattctggatgctcttcatttagaatttcattttctgccatgccatttgccattacgagtaccatatcgtttgtcgatgtttctccgtcgacggtaatttgattaaaggttacatctgtaatatcacgaagtgcgttttgcagagcttcttgttcgacatttgcatctgttgtcacgaagccaagcattgttgccatgttcggatgaatcataccagagcctttcgctgcacctgaaatgagaatctctttgccgtttatcgtcagggtgtatgttgtgtttttaatgactgtatctgttgttaagatggcctcttcaaaatgaccatttcctgcttttgcttctttcagctgagtgatgccttttttgattttatccatatccagatactctccaatgacaccagtagaagaaacagcaatgtaatcaggttctatccctaacatatctgcgcaggctgcctgcatttcgtatgcgtctttcaaaccttgctcaccggtacatgcattggcgatggcactattgacaatgacaccttttaattgccctgtcttttttaagcttttctgagtgacttgtagaggcgcagcttgaaagtggctttgtgtgtataccgctgcactcactgccggcacttcactgacgatcagtccaaggtctttttttgaataacgtaatccaatatgaatcccctttgcttcaaagccttttggtgatgatacgtcaccgtctattttaacaatgcttttttcattcaattcgatcatgtttgttgtctcccttgttcttatggatagagaggtgtcattgtgaggcccgcctcttcatctaagcctttgatgatgttgaagttttgaaccgcttgaccagctgcgcccttcatgagattgtcgatcacagacacaattgtgagtctgcctgtacgttcatctaaatgaaagccaatgtcacagaaattactgccgtatacttcccttgtttgcggatatacttcgtgatctctcactctgacaaaataggaatcttcataaaagcctttcatatgcttcatcaattcctcttttgtgatatctgatttcagctgagtatacatcgtcgccataatcccccttgtcatcgggacaaggtgcgttgaaaatgtgatgttcgccgtttgcggattccaatctcttaatatttgctctatttcaggtgtatgttgatgttcatttaccttataaattttgaagttgtcgtttagctctgaaaaatgcgttccaagtgaggcagatcgtcctgcaccggacactcctgtttttgcatctatgatgatcatagattcatcgattagattctgtttcatcagcggtgctaaaccgagaagaactgcggtagggaagcaccctgggtttgcaatgacttcagcctgctcaatcgtttcacgattcaattccgataacccatacacagcttgttgaacagatacttgatcagctgcccttcgtttataccaagcttcataggttgcaccgtcttgaatacgcaaatcacctgataaatcaatgataggcactccttggttcatgagcttcggtgtgagttcacttgatacgcctgctggtgtcgctaaaaacacagcatctgtttctcgcacaatggcagcaggatcaatggcttttaatgtttgatcagtaatcgttgttagatgcggataagattgactgtataattgcccatcaccactcgatgaatacaatatacattcatcgacatgtggatgctgcttgaagatacgaactaattccgcaccaccgtatcccgtagcacctataatacctattttcaacgtcaatacaccctcttgatctttgtgaaattatttaacattataacatgtataaaaattaattcaattgtatatttaatatttcttttcattttttttcataaaaaaatccacatatcttcataagacatgcggatttatctttcatatttcatcatgatgactatgagagcactgcataaatataatatggagcttgcataaaaaatgaaataaacggtgaagaaatctgcaaacaggccgccaagcataatggctatcgatgaaaaaagagctgtccaaaaatgatagcggccgacctctttcattcttttgttctctgttgtcagttccgtgacaagcagtttttccccgtgcttttgaaagccgccaagcgcaccaagtgcaagctgaatcatatacacctgttccacttctgttatatgcggaaatagcagtaaaagaaatgccataccgaacgaatgaataattaaaaagagccgcctgtcagtagtttcgggcagttttcctaagagtaaatgaataaacgctccgcttaaaccaaacaagccataggcaagaccaaactgtgaatagcttgaaccaacatttttaataaaaagaatgtaaaaagggaaaatcaaactgctggcgaaaaacagcaggctttgtgagtagacgaaccatttcattgcttttgcattcattgtgtattgtacctttcataaaagtaattgataaatctgccatctggatctgcttgctgtttcttttggaagaatacatcggttttaggataggcccgcttcatttgcgctttcgtttgataaggcatgtacggtaagtaatagcttccatggtgccgaagcgtgatatctgtcatttgccggatgatccgctctgcttctgccttcttttctttctcaaaaccataattcactaaaagaacaagggcaaacatatcttctttcgcatatgagagatccgctttttcatttttttgtacgtatcgtatcgtaatgttcattaaattcaattcttcctgttgtaaatagcttctcatgtcatcaatgtacgcacgaaagcggtccactgggacgaaatattcctgaagcacatctgtatctgactcattttcatattctaaaaaagcagaatctgagcgcatcacattgtttcttgtgatcaactgatcattttgactttggaaatacttcttttgtaaatgccagagcagatctttccccatatcaaatcttcttgaaaggccgagcataaatttgagtggcatgacgagttgatcctctttcagctcttgatatgattcgatctcttgttgtgaagtgagggaataattcgttacatacatctctttcaaaaagtttgttttcgttgttgagattctggcaagatgcatgcgtacttctttattttgtttgacatgtttttgaaaataattgctgtattcgcgataatcaagagaggttgtctccattttgtataactcatctttcgttaacgaaagctcaacatctaaaatgacgccgaacaaaccatatccgccaatcacggcagtaaacaaatcattgcccggcttcactgtaacgatgtccccatctgcctgaagcagcctgaaggaacgaactgtgtctatgagtgagccgtagcgaatgtcacgtccatgtgcgtttgcactgagagaaccgccaatcgtgaagatattctgtgattgcatgaccttcacggcaaggccatatgggttcacatatgtttgtatatcatcccatgtaacgccgctttggaccctaatcgttttctttttttcatcaaatgctaaaatctgacggaatttggtcatatcgagcacgatgccattttcataatacgtgtggccacccatgctatgctgtttccctgcaattgatatcggcaggctttttgctttcgcttcttttaatacttcttttaaagtatctatttcttttccttgaacgattttttttattttgacaggcatgagatgactgacatctgtaaaggcttctagatcttggcttttgtgtgcttgctcctcacgaatggtgattgacgcaaaaaatgcagctgcgtatcccatgaaaagaacaatccataaccattttcgtttcattataggtactccgttctatgaaattacacccattatatcgtactattctcttcctccaccttattttttcataaaaaatgcctggcatgagttcaactcataccaggcatttttatttgtgcttattgaataccgagcgcaatttttgcgtatcttgacattttgtctcgtgtccaaggcggattccatacgatgtgaacttctgtttctttcacttctggaagatcacttaatgcttttttcacttcatccacgataactggtgcaaggggacaccccattgatgttaaggtcatcgtgatatccgcttttccattctcatcaagatcgacatcatagacaagtccaaggttgacgatgtcgacattcagttcagggtcaatcacctgttctagggcgcctaaaatattttctttcaatgcttcatccatgatatccactccttttccattagtataacgtactttttcttttgactaaacgtttgtgcttttcagatgtgtcacaaaccactcaatcgtttcaaacattgcttgtcttgagaccttatggccagcctgtccatctgtgataaaacgaatcaggtgcggatcttctttatattgggttgctgccaactcgtcataaagagcttttgcatgtctgtaagggacaactggatcgttttccgcatgccagaataacagcggtcttttgtttaatcgatctgtttgcagcgttaaatcataaggacgcagcgcgtctaattgctgatgaacctcttcgtctgtaatctctttcatcaaccctttgtgccgcatgtccataatttgtgcttgtaggaatgtcgtatatttcggactgcccatcaagctgactgccgctttaatccaatcatgttttgcgagtgcaccaaaggtcgtgatgccgcccatggaagtacctgcaacaccgatcagatcggcttcaatcaaatgtttttcttgaaagtatgttttgagtatatcgatttcacgtatttcgttcaggacaatttcccagaaccttgacgccagttcctctaagctgaggttttctgatcttacaccatgataagcacagtcaggcaaaatgactctcatgcctttttccgccaaatgaaaggcgaagtgtaaattgtgctcgcgtgcacttgtaaatccgtgtataaaaaatacaagcggcagcggtttgtctttattttcagcttttacgatatgtaaaaatggaatatcgcgcgtaatttgctcatcaatggtgatcacagcctatgaatcctcctttatcattcccgtctttgtttattttaacatgtagacaacaaagatgtgataaagatacactataggtagaggcgccgcacgaactgcctcctatcacttacagatcaaaggagattttatggagactaaaccttatctaatcgcacttgacctggatggcacgttattaaaagatgataaaaccatctctgcgcatacacttgacgtcattcaaaaagtgaaagacagcgggcatcatgtctgtatttcaaccggccggccatttcgttccagctctccttattatcagcaattacagcttgattcacccattgtgaattttaatggagcgtttgtccatcatcctcttgatgaaaaatggggcagatttcatacgtcacttgatcttcaagtcgttaaacagcttgtagacattagtgaggagtataaagtacacaatgtgctagctgaagtgttagacgatttgtatttccattatcatgatgagaaactcattgatatatttaatatgaatgcaaataaagtgactgttggagaccttcgggacaaccttggagagaatgtgacgagcgtgttaattcacgcaaaagaagaggacgttggagctattcgaagctatttatcagatgttcatgcagaagtgattgatcataggcgatgggctgccccgtggcacgtgattgagatcattaaaacaggcatgaacaaggccgttggactgcaaaagatcagtgattattacggcgttccacaggagcggattgtggcattcggagatgaagacaatgatttagaaatgcttgaatttgccggatgcggtgtggcaatggacaacgggattgatgccgtgaaacgtgtctcaaatgaagtcactgatacgaatgaacaagatgggattgcaaagtttctaacgaattacttctcgctttaatttttccattcatacatagcagatggaagcgggcatactaccgttagacaggttgtcctgtcagcttgtgtaaaggggcggattccgaatgggtaaaagaagcaaatcgaaacgctttatacaacaaggtaaagattcagtcagtctgcatgatgcacgttttccttatcgttctacacttgaagaagtgtcagacaaagaaaatatgaagactgatgcttctggaggttcattgtgagaaacgaactttttgatcaagccaaatcatttactgaagaagcccttacttcttcattttcatctgggttagagcgtcaacaggcggtcaaacgagccaaaaatgccgtatcttctgcatttgccaattcgacagatgcagaaagaaaccagctacacaccttccaagacttgctcgatgatctctaacataaaagaagctgtccattaaggacagctttttctgattctcatgaagctgaaagcacttatttcacttggaatgttttcttttccgtgatttgcttcagcccttctgcttttcctttaaatgtgacgaccgcttcatacgttcccggcttgacaccatttgaccacgtatcttgaaaatcataggcttcgcctttctttagcacaaatgattggatggcctgagtgaacatacggtcttttgaatagcggtattgttcatttccgttttcgtcatacacactgagctcgaatttttggcttgtgttaaaggtaaattcaatatctcgatctgattcatttttcagtgacatgttaaattgaaccgaagaacctttctggacggggtctactgtgagtacaaccgttttttctcccatttgaccggatacctccttgtctggttcatcctttttttgttgtccacaagcggttaaaatcaatacaacgagaagaagtaccaacccttttttcatacgctacccaccttttaatctcgtctgaaaaatccaagaatattagttgtttgcacaatatttgtaaaagcttttggatcgacttctttaataatttgttcaagttcatacagctcataccttgtaatgacgatcaccatcatttcttttggctcgttggtaaaagccccctttgcaggtaccgtcgtaatgcctctgaccatttttccataaatggcttccttgatttcatcagccttctttgtcacaatcatcgcggtcagcttctcatgtcttgtatggatggcatcaatgacccttgtggtcacatataatgtgacaagggtatataatgctttctcccaaccttgtaataatcctgctgtaaaaatgatgataccatttaaaatgaagaaatacgtaccgactggtttatccttccacttcgccaagatcatggctatgatgtcgagtccgcctgtcgatgccccaaatttgagcgtgatcccaatccctactgcggatatcacgccgccaaacacagcatttagtaaaatatcatgtgaaacactcgtttctggtaagatgccgaggaaaatggtcgtcagggcaacactgatgatgctgtaaaacgtaaaggaacggcccactttcatccagcctaaaatgccgactggaatatttaaaataaataatagaattcctgtggatacataaaatggggcatattgatccattaagctggataacagctgggctacccctgtaaacccgctcgcgtatacatcagctgggattaagaataaattcagtccaatcgcattgagcagtgcaccaatgacgacgacaatgagtttttttgcttctccgatgaacatattgtcattcctccacttaccattctctctatggttttccctaaaatttagaatttgaacacgaaaaagtgatttctgtgatatagttaggctaaaaagttgcaaaatatggctgatttttttagaaagaagggattttgatgactgttcatatcatagcagacagtgctgctgatctgcctctttcttattatgatgaacataacatgacgcttattccgctccgtgtattgcttggcgaagaggaatttgaagatttgatcaccattgaaccaaaacaagtatttgatgcgatgagacaaggcgccagcccaaaaacgtcacaagcttcaccaaaccgaatcaaagaagcctttgtttctctcgcacaaaaccatacatctgcaatctatgttgccttttcatcagagctttccggtacataccaaacggctgtgatgatggcaaacgaagtgaaggaagaataccctgattttgatttacgaatcattgattctaaatgtgcttcactcggctatgggcttgctgtcaaacacgctcaatcacttgccattgacggaaatacaatacaagaaattgaaacgtctgtaaagcatttttgcgaatctttacaacatatttttactgtagacgatttatcgtatttagcaagaggcggaagaatcagtaaagcgtccgcatttgttggtggtttattgagtattaagcccattttacacgtcgaggacggaaagctcatcccccttgagaaaatccgcggacgtaaaaagctgttgaaacgcattattgaactgatgaaagaacgtggaacggattggtcaaatcaaactgttggcattagtcatggtgatgatcctgcacttgcagaagacatgagagaattgattgaagccgaatttcatccaaaggaaattgatattcagattgtcggcgcagctgttgggtcccattcaggaccaggcacgcttgccatcttctttacaggcaaaccatcataaaaagcacccttccctgacacatcacgggaagggtgcttttcttatgacttatgaaagtttaaaacggtggacggtttcatttagccttgccgtcatactcatgagttcttctacttgtttgttcatttgatggaatgattgcagctgttcattggcagaggcagaaatttcttcactgccagctgctgtttcttctacaaccgcactaatattttcaatcgagttgagcacttgtccgccaagctctgttgattgaacaatttggtcatttaagaccgccatttcttgtttaatgtgctgcgcttttgtttctatatcttcaaaggagtgtgaggttttgtccatcgcatcctgctgctgaagtgaaagcttgactccttctttgacagtttgactaatggattgaatgcctctttcaatatgactgaccatatcaaagatttgtcttgtagcgttagatgattcgtcggcaagcttacgaatttcatctgcgacaacggcaaagccttttccagcctcacctgctcttgccgcttcgatcgccgcatttagcgaaagtaagtttgtctgatccgcaatgtcagaaactgttttggccatagccgagatcccgctggcatattgcgtgaattctcctgccgactgttcgatttgtcttgtggcatgtgtgtttttttcaatcgccgttttggtttctgttaacgtgtgctttccactttctactgcttctatcgcgtccgctgtactttggatgactgtttgtgaacgttcggaatttttacgtccatgctgatccatcttttcaatcaagctgacgccatgctggagatcctctgaaatggcttgtgacccatttgccatctcgtctgtcgagacagatacttgatttgcagattccatcagctttttgttttcatcatctaactggatcgagaatgtctctacttgacttgagacattactgatttctttaatcaaactaatcagttgatctgtcatttgattaaaggattcattcaagccgccgatttcatccttacgctgaatgtccatccgctcgacagcaaggttgccttctgcgatctgcttcgctctgtaggaaagtgatttaattggtgtcacgatggatcttgttaatccaatatttaaaaagacagcaatgacgatcagtgtaagggctgcaacgagtgcacttgtgatgatccattgcacattatccgctgtattctctagattttgtttatacgcttcttccgctcttttattcattgtatgcacgtcgtttaagacgccatcaattcttgctgctacccgccttgcatctgatgcatttttttcaccaatggcgccattcgcttccttggtccacgtatcatattttgcatttaaccttgttagtgcatctttattgatattacctgcatttttgtttaacgtttgcagctgtttttttgctgtagaaatatcggtttgaacaacttctagctgttcatcagacagtgtcattgagtaattggtcatggcttgttcgacactttcaaagcttgcttttgttttttgaacgtttaataaggtttgaacttctgtttcatttgatgattggatctttgtcatactaacaatgataaaggcgatgacaccaactgctaaaagaagtgagacgagtgagttgagtaaaattttgatgcgcaagctcatgatgcgtccccctcttcttttagcaatttctgcttcagttcatttacttttttggtcaatgcttcagcattcttcagcacccgaattcttgccatgtcgattccgtcattgcttaagtcgtaaataacatgcccatttttgattttgttgctcttgacgagctgttcgctgaattgatagaccacttcgtcgactttttttaccatggacgaaatcaccgctttttcagcggtgtagtactgatcactatctacaccaatggcatacttgccctctgattgtgcttcttttaatacaccaacacctgtatagcctgctgcggcatataaaacatctgctttctttttgatcatgtctttggctattttactgcctttgcccgcatcactaaacgtattggcataggtggataagatcttaattttcggattcactgatttggcgcctttttggaaccccttttcaaaacgatgaatcacatccgcatcgacaccgccaacaaatccaatgacatcacttttcgttgtcatcgcagcaagtgcgcctgctaaatagctgccctgctcttctttaaacgtcacggaggttacgttttttagctcagatacagcatcaatgagcaagaactgcttcttcggatatttctttgcgactttttctaagtcttcttgcatactaaagcctaccccgatgacgaggtcattgccagcttttacgagctcggtcagccctttttcatatgtatcggtttctgcaatttctctataatcaaattcaattcctaggtcatcacgtgctttttctaatcctttaaatgacgaatcgttaaatgattgatcaccaagaccatcatctgtgagcataacgccaatatgcttcgcatttgatgctggtggtttcccttgttgattgctgcatgcagctaacaccataagcatggctaccaacagaagtaatgaaattttcactttcatccaaacacacactccttttatcatccttactcctttcttatcggatttgagaggcgttgtttcaatgattatgtgaaggttttccagattttttatgacttttttcactgaaaaaaaccattatttataacaaatataaaaaaagggataaaatcatcatgattttatccctttttcttcatttcagtgtaatgtgaaaacccatgaggttagagttctctttcacgctgctcattttttctcgtatgtccagccctctttttggtagactaggccgtttttcatcaaatgacctaatgctcgtttaaaggctgccttgctcatttggaatcgttcgcggatgtcttctggatcacttttgtctccataaggcatagcgccatttctcgttcgcatataggttaagatttcttctgcatcgacagataacgcttcctgttttctaggaagcagagacacgtttacggttccatcctctttcactgcaatgacgcgtcctgtcacggtcgatcctaatcttggttcttcctttcgttccgtacggtggataaaccctcgcacgcctgtatctgtcagcataaacgagcctgtcgcaattaagcggtaaatcgttccagtgatttctttgttcattaaggtttcaggtgcctcagtaaacaattcactgatcacatcttcagtggctggctttgcgaacattctgccgtagcttgtgactttcagcatacagtaaagtttgtctccttttttcggccatgcttcctcaaaaggcggtagatgttctgttgcaactagtgcatcctttgaaagcccgacatccacaaatgcacccatgtcttctacgacgtctacgacttctacccagccatatgtatgcgcattgattgaaggtattttcatcgtcgcagctagtctttcttcatgatctacgtataagtagacctctacttcatcctggtcaccaatatcttctgtcatttcactgcggtgcaaaaggaccgaatcttctccatctgtcaaaaagtaaccgtattccatctcgttctctatttgcaaggtcagttgctcacctggtctcatgttctcttccttcctatctgctcttaaaagagcgttcgttcatcttttgattcactttattctactatacttctcctcacatgaacatctctagttctgttagctaaagtggacaaaccgaacacgatttataccgctactggcagaactctttgactcgtctcttcgataaagtttcttcttctccacgttgcatgataaaatagacgcaatatctatacatggaggtcatgtgttatggcaaaagaaagctcatttgacattgtatcgaaggtggaactgccagaggtgcaaaacgccgttcaagcagcgctcaaggaaattaaaaaccgttatgactttaaaggaagtaaaagtgatatttctcttgaaaaagaagagctcgttctcatctctgatgatgacttcaagctggagcagctaaaagatgtccttgtgtcaaagctgatcaaacgaaacgttccaactaaaaacatcgattacggaaaaactgagcatgcccttggcggaacagtgcgccagcgcgcgaagctgatcagcggaattgatcaagacaacgctaaaaagatcaatgcactcattaagcaatctggcatcaaagtgaagtcacaatttcaagatgaccaagtgcgtgtaacagggaaaaataaagatgatttacaagaggttatctctcttatgcgcaaggcagatttaccgattgacgttcaatttataaattttcgataaatttcaaattttccattgattatttccgattttttcgatacagtggatggaagttcaattcattgacatgttcatatcgctttcttatcaagagaggcagagggactggccctgtgaagcctcagcaaccggtgtagtagaaaaatattttctatgaccaaggtgctaaatccagcaagcaactgcttggaagataagaagaagaataacgatacagccaaaaagtcttcttcttatcagaaggctttttttgttacatagaaataaggaggaaaccaatgggcctattacaagatttacaaaaccgcgtactgattgctgacggtgcaatgggaacacttttatactcttacggcattgaccgctgctttgaagaattaaatttatcgaaagaagatgaggtaaagcgcgtgcacgaagcatatgtgcaggctggtgcagacatcattcaaacaaatacgtacggcgcaaattatattaaactatcccgctacggcttagaggaagaaacaaagcgtatcaatacaaaggcggtacaaatcgcaaaatcagccgcaggctccgcttatgtccttggaacgatcggcggtattcgaacgtttaacaaaaatgcctacacgattgaagaaattaaacgaagctttagagagcagctatacattctattaaacgagcagcctgatggattattgctagaaacgtattatgacatggaagaagcgaaggccgttctccaaattgcacgtaaagaaacgactctcccaattgtcatgaacgtctccatgcatgaacaaggtgtgttgcaggatggaacaccgctcaaggatagtttatctgaattgtcttctcttggtgcagacgtcgttggcatcaactgccggctgggcccttatcatatgattcaggcactcgaaggcgttccaattttagaaaattcccatttatcagtctatcctaacagcagtcttccctctcttgaagaaggcagactcgtctatgatacagataacgattatttccgaaaaagtgcacttgaatttagaaatcaaggcgcacgtattatcggcggctgctgcggaacaacgcctcagcatattcaagcaatggctgaagcggtcaaggatttagcaccgatcactgaaaaagaagtgaaagttttaaaagaagaaatcatttcgattcaagatcagcggactgaaccaggtcttgatgagctcgctacgaaaaaacggacgattattgtagagcttgatccgccgaagaagctgaacttcgaaaaatttctcgtcgcggcaaatgagttaaagaatgcaggcattgatgccttgacattagctgataattctcttgcaaccccgcgcattagcaatgtggcttgcggggcattattgaaacagcagcttgatatgcgctcactcgtccatatcacatgccgtgatcgtaatttgattgggcttcagtcccatttgatgggtcttgacacccttggtttaactgatattttagccattacaggcgacccttctaagattggggatttcccaggtgcaacgtcggtttatgatttaacctcctttgatttgatccggctgattaagcagtttaacgaaggcctttctttctcagggaaaccgattggcaaaaagaccaatttttcagtagctggcgcgtttaatccgaatgttcgtcacattgataaagcggtcaaacgtcttgagaaaaaaatcgaatacggtgctgattattttatttcacagcctgtttattctgaggaacagcttgtgaaaattcatgaggagagccgtcatttagataaaccgatttatattggcattatgccgttaacaagcagtcgaaatgcggagtttattcatcatgaaattccaggtatcaaattatctgattccattcgtgacattatggcgagggctggtgaggataaagaaaagcagcgagcagaaggcttagcgattgcccgctctttattagatacagcctgtgaattgtttaatggcatttatttaattacccctttccttcgatcagacttaacagcagaactaaccacctacattcatcagaaagaaaaggagtcaaacatccatgtcaactatcactgaacagctgaagaaacgcatcctcgtccttgatggtgcaatggggaccatgattcaaaatgccaatctcacagcagaagactttggcggcgaggagtatgagggctgtaacgagtatttgaatgtgacagcccctcacaccatccgcacgatccatagagaataccttgaggcaagcgccgatcttattgaaacaaatacgttcggggctacaaagctcgtccttgacgaatacgggcttggccaccttgcctatgaactcaatgtacgggctgcccagttggcaaaggaagaagctgaccgtttctccacgccggagcagcctcgatttgttgtaggtgcgatgggtcccactacgaaaacattatctgtgacaggcggcacaaccttcgatgagctcgtcagaaactatgaagagcaagcacgcgctctgattgatggcaaatgtgatgcccttcttttagaaacaagtcaagacatgctgaatgtaaaagctggtttcaaaggcattcaggaagccttccagcagacaggtattgagctgcctctcatggtatcaggtacgattgaaccgatgggcacgacccttgctggtcaggatattgaagccttttatatttctcttgagcatatgaaaccgatgagtgtcggtctgaactgtgcgacgggtcctgaatttatgacagaccatatccgcacgctatcttccatcgccaagtcagcggttagctgctatccaaatgctggtctccctgatgaagaaggtcaatatcatgaatccccagcttcacttgctaaaaaaatttccgcctttgccaaggaaggctggttaaatattgttggcggctgctgcggaacaacacctgcacatatacaggcattgtcagatgaagtacgcacgattcagccgcgtcacatcacgcatgaatcgtctcagcatactgtatcaggaattgagcccctactatatgaggaatcaatgcgacctctttttgtaggagaacggaccaacgtgattggttcacgcaaattcaaacgactcattgcggaacaaaagtttgaagaagcgtcagaagttgctcgtgcacaggtaaaaaacggtgctcacgtgattgatgtgtgtctcgctgatccagaccgcgatgaggcagcagacatggaaggttttttacaagaggctatgaaaaaagtcaaagccccttttgtcattgattcaacggataaacacgtgatcgaaaaggcgctgacatattcccaagggaaagccatcatcaattctattaaccttgaggatggcgaagaacgctttgaagaaattcttccacttgtgaagctgtacggtggtgcacttgttgtcggcacgatcgatgaaagagggatggctgtaacagcagaacgaaagctcgagattgcggtacgctctcatgatctattaacgaagaaatatggcattcccgcaagtgacatcatttttgatccacttgtctttccagtggggactggagacgagcagtatattggcgctgccgaagaaacgatcaaaggcatcaaaatgatcaaggaaaaactgcctgagtgtctgacgattttaggcatcagcaacgtgtcttttggactcccgcctcttgggagagaaatcttgaatgctgtctacttgtatcactgcgtccaagcaggacttgactacgccattgtgaatacagaaaagcttgaacgcttcgcttctattccaaaggaagaaatcaagctcgctgaaatgttgctctatgaaacaaatgatcaaacccttgctgaattcacccaattttaccgcggcaaaaagaaaacggagaaaaaaccaaagatctccttatcacttgatgaaaggctggcactctatgtcgtcgaaggaacaaaagaaggtcttatcgatgatttatcccttgctctacagcaatttgaatcaccacttcatatcatcaatggtccgttaatgcagggaatggctgaggttggtcgtctttttaatcaaaacgaactgattgtggcggaagtgcttcaatcggcagaggtcatgaaggcttctgtatcgtatctcgaacaatatatggaaaagcagcatgcaagcgggaaaggtaaaattctacttgccactgtaaaaggagatgtccatgatattgggaaaaaccttgtcgacatcattttgagtaataacggctttcaagtggtcgacctcggaatcaaggtgacaccgcaaacattgatcgaagctgtgcaaaaagaaaagccagatatgattggattatcaggattactcgtgaagtcagcccagcaaatggtcctcaccgctcaggatttacaaaaggcgaatatttcagtgcccattttggtcggcggtgctgcactttctcggaaatttacgaaaatgaagatttcgcctcattatgacggacccgtcctttacgcaaaagatgcgatggacggcttatctttagccaatgagttaaaagcaaatcctcttcagtttcaaataaagccagatgaagagcctgtggctcctgtcaaagagaaagaaacaaagcagccacaagctgtcattgaattactagaaaaacgtgcggcactccctgaggcacctattttcacaccagaaaatacggcacgtcattatgtaagagacatcgacctgcatcacattatgccttatgtgaatgaacaaatgctcattggccaccaccttggattaaaaggaaaggtgaaaaagctgttggccgaacagcatccaaaagcattggaattaaagcagcttgtcacagatcttctaaacgaaggcagagagaaaaactggtttgcgcctgcatttgtctatcaattttatcctgccagttccaacggaaatgatctgcatatttatgatcccaaagcgcctgaccgtatcattgaaacgttccaattcccaagacaggagaagcttccatatcgctccatttctgattatgtgcgggggagcggtgaaaaggagaaagattatattgccttatttgctgtcacagccggagcgcgtatacgtgaagtcgcgcagcaatttaagcaagaaggagattatttaaaaatgcatgcggttcaagctctggcgcttgagcttgcagaagggttagccgaaagaacccaccaagtgattcgtgacaaatggggcttccctgacccagtcgatttcacaatggaaaaacgattccaagcgaaatatcaagggcagcgctattcctttggttatcccgcttgcccaaatcttgaagaccaagaaaagctgttcaagctgcttcagcctgaaaaaatcggcatccatctgacagaaggatttatgatggaacctgaagcatctgtttcagcaatcgtcgtttctcatcctgaagctcgatattttaatgttcattaatgcaggacctccgaaattggaggtccttttttgatggggagattagataaacttcaatttttacagtataccttcttatggtacgatacacatagatgaattcagctaagaaggagttgcatgtcatgacaaacgttgttcaacgagcattaacgctcgatgacataccagatcttatcgcattgtcacaagaggtagactggcctgattacaatgcggaagagctcacatctcttttaacaaatgggtatttcacaggtttttcaacggcggatggacaagtcatctcatgtgcaggacttttccaatatgatcgaatggcatcaattggtgccgtcattgtatctaggacacatcgcggcttaggtcttgcaaggaaaatgattgacaccctgctagatcaatgtgatcaaagcattcctgtctttttaaccgcgactgttcaggggcggcctgtttacgaaaaaatcgggtttcacacggctggttacattacgacttacaaagcacaaaacccgaaccaagaagcgcttcgtgtgtcagatgacatttacctgtctcctgccgatgaatcgcaccttccgtgtattgaagcactagatgaaaaagccgcaggcacaaatcgatcaagctttttaaaaaaccgaatgaaccgggcaacgcagcgtatcattgcaaagaatgaacatcacgaaacaactggctttgcgtttggcgttgaaacacctgccaatttaatgattggaccgcttgctgcaaatgatgaacttacagctctctcgctgattcgttcgctcatttcgtcttattcgggtccgattcgtttagatatgcaggaagaaacagctgagcgcctccatgaatcacttgttgaagcaggttttacgaaaacaaacaaagctcattttatgatgattcgcggaaaagaaaagctgaacgatcccgcccttctttatttccttgcctctcaagcattttcgtaatatataaaaagctgtagacacttgtgtctacagcttttctattacttctcacaggtggacgaaagaacatgtgcgagtgcatttgtgacctttccatgctctgatgcatgcgggcggtcatctccgtctccatacccataatcaatcattcgattacgatttaagcacagctttgtcagcttcggctggaatagatcaaagagttcaaaacggtccttcagctgtgggaattgcttttgatactgctgaatttcttcggcaagcaagctccaaagtgtcacttcatctaatagctgatggttctctaacacgtttgatacgtaacgcaggttgcaaataaacaatcctgtaaagataaactgcactaagccttccggcggttcactccgcagcacttcttttaaatcgtctcctagagaagccaattcaggcagcggctgatcactaatgttcacatcgtcaacaaaatctttgatcgccaaacgatgaggctgatgatcttttaacacaagaatcgtattttgtccgtgcggtgaaaagacggtgccgtattgatacataaaatgtagcagtggcggcatgaccacatggaaaaatttcgccatccactctttagctgagagacctgatttttcaatcagctgtttcacatatggctcaccttcatgatcctcataggtgagtgccgcaagtgtaacaggggtctctccttcatctaagtacgagtaaatgctttctctaaaaatcacaccgagcatctcaagatattgatacggcgcaccaggcagtttgctatagtaaggatgatcgacattaatacttgcattctcaccaggtaatatcacgcggcagacatcagataaaaatgaatcttggtccgcaatccctttaatatgcgctgtaatacgaggggcaatgactgtccgttctgacggaagtccccggtacacaagcgtatttaaaatactcattggcagtttaatatgatgcttgcctttatttgagatgttcgtaaaagttctgatcgactgctgcgggatatattggtccagtccctctcctacatacacaatccggcgcatcgccaaatcttccgggaaatgctgaataatcatgtgtgtccactgccacttatgaacaggcatcaaataataatcagctacaatcaatccttcatcctttagcacgcggtgaaattgacggatcgtgacttcatctaactctttggcgattacctgctcatagttttcatgatcgactgcatggaatgtcgcaaggtcccggtgaacagcaatccaagacagctgcacactttcttgcctttcaggtgcataggctaggtagtcatcgtaactgaatccaatgcgtcctttgttatacacaatccaaggatggcctgtcatctctccttcaatccatgcataatcagtatctgttaactcatccgcacgaagtgcttttttcgaaagcaaatggacatccgctaacagggtatggtgaagctcttttataagatgtcctgttgtctcagaagacattggaatgagcggctgaatgtctagtaaaaacacgattgcactgacatcctttgaccactttccatcttgacagcactcgattgattcagcgattgtatcaaaactatcaaacaaacgaggttttgcaagatagcgatatttcttctgttcgtgaataattaattcatactgagcaatgccatccttatgatctagctgcacgggatgaagcatatcctcatacatgtattcagacagcatttttgctaccattcgctggtttgcctttttccaagcagcaggattcaccgcttttttcaattcatcttgtacactcatcgcttcatcctccttaacctttgatttcttcaaatgtgttgacgttcatacgtgtaccaaatgtctggaagacgtgcttttgataaagtggatacacagtttgacgagcaagttcattgataatcacactatttcggtaagcaccaagccctaaatccggggcgccaacaccatgtgtatgaagctctgcattttggacaaatatatcattttcacccattgtatttgttttcaagcgatattcacgttcaacttggaaccgtccttgatcgtcccattgaatgtgatgagaaattgggttgataaacggcggcagtaccgattgatagcccgtcgccagcacgacaatatctgtctcgtgggtaaaggagtcctccttgacccattgcgtgcatgaaagggacaagccgcgagatgtttcctcaatcaagttaacctccgtcatcgcttgaagcactgtgttcaactgctttccgcaggcagaacgttcatatagcaaatggtaaatatcacggatcattgcagagctgatgcccttatacagcaagtcctgctgctttaacaacgcatccttttttgtttgcggaagctcataaaagaaatcaatataatctggagagaaatattcaaggccaaggtttgaatattccattgggaaaaatcctttagagcgtgtgaaccagtgaatatccttcgcctcatcatctgataaaatatcatagaacacttctgccgcactttgaccagagccgatcactgttacagatttccctttgaaacagccttctttttttcgttttaaatagtcggcggaatgaaaaaccttctctcctaaagctggctggagcgatgctggtatcgccggctgtgtaccaattcctaagacaagatgcttactttcaaacacctctaccgtttggtctttcacatgacgaacatgcacttcataacgcttttctcctgctttctcgatcaatgagacagattcgacgttcatgccaaatcggcaagagtctaactggtctgcgacccagcggcaataatgactatattccttgcgcgggatatgaaaatcctctagaaagtaaaatgaatacaaacggttttgttcctgtaagtagttaagaaagctatatttacttttcacatctgccatactgacaaggtccgctaaaaagggaacctgcagtgtcgtcccctcaatgagcatccctgggtgccaatgaaaggcttcacttctttcaaaaaacaaagcgtcaatatcatttacctcttcagataatgcggcaagacctaagttaaacggaccaatgccgattcctattacatccactacattattttgcttgttgaaccgcgtcatggttatacttcctttcgaatcgttctcgatcacaaaacatcaaaagacctgttttatcgggtaaattgactggttttacacgttcaaagccgcatttttcaaatacatggatcattttttcattgcaaatatccggctcagcgacgattttttctgttcgtttgttctgctcaaattgaaatgctgtcatggcctgaagcagcggggctgcaaaaccttttcccacataatccggctcccctattaatagatggattccttgatcatgcggagaaggctgatagtaagattcaatgacatcacctttgacgttgtacgcctcaaaataactcatgggtgtcccatcaattgtgcctaaataaagggtttgatgcggatcatgaattgcctgataaaaatgcttttcaaaagcaggaaacggaatattcaaatgccaaaatgggtgaacatactcctcttgcatccacttgtggacaagccggacatctctttcatattcagcccgaataaaatgaatacgatgcctcatccaatcagcgcctccttatgtaaaaaaagtggattcaaaacagctgtgtaacgagactgtgtttccagagatcctgtcagctcatccatatcttcaaaccgtgtcagcaaattcgcttttgaagggagttcctttgagcgaagtaggctgtttgtcagttcagatgcaccgtatgtttcctcatgagcgagcaatgtgtctctcacaagggcgagcaagtcttcttctttcgccagaccttctgtaccaaagccgttaataagaccaaataaatgattaaagaagaaataataacgcagtctctcaacggctacatcatctgcacaaatcgtttcacttctcacgctcaggttttggacaagatttgcgagtttatcctttttcgattcactataatagtagccttggttgtcacgataatagaaggtgtgcgggtaaccatctttcatttgcacaacagcgttttgctgatgggcttcaagcgcaagaccatacgtttcaaacagccaaagcatcggttctaacgaaatggttaaatattgcttaaaccaatcttggcttacatcattcgttgatcggccttctgcgtctgcaaggtcatgaatgatccctgctaatcgcgattttccaccatacgcatgatcctgacacaatccagcaattaagcttgctcctttttcacgatgtaaaaatggattttgacgaatgactacttcaaagccagattccgcctcttctccttgaatggataaataggcgggatcttcaatgacccggaatccagaaaatttgtcgtataaagaaacgcctaattctgtttttaaaatgcgcgacatctctacaccgcgatccagttccttttgtttattaacacgtaaggagtttgtaattttcacaggaacagagaatttgagcatgtaagcagaatccttttgatagacggttctgaaagatgaggtcgctgtgtattcagatcccatcggtcctaaataagagagtttcccttcctctatataacggttcacgaacgctttctccatgaccaccttcacttgaagcggatgaatcggaaggagcacatattctccgttttctactaacgtattcactctctctttttcttctggcacttggcgcaagagctcctctagcatgagacttgccgcagactgtgtaatagacgaatcctgaagcacaatcgaatgatgcgctttaaagtaatgaagctggaaagtccctttcagctcaggagaatagattgcttcctcctcctctgtcattccttgtctgctttttggggtaggatgcgttaaatgaccaaggagaagtgactgctcagcctcgatatactcaaaatcggcttcagaaagagcggatcgatcactttctcgctcctttaagaaccgttcaatatttcggcagcttaaaatgatgcgaagcataaattcatcctctgcatctgtacggccatattcaatgagaagctcctttgaacataaagcaacaagtgtcgtgtaatcgacgattgccccctcttgttcactgccttgcgggcgaaagcgaatcggaaaatcaaagagatgacggccaacagatgaaacatatcggatcggaatcacaagctctagatcttgttttgctagttttgcgatgaagacaagcgagccatctgctctcacctctttttttgcagatcgatcgattcctgtttcgcgtaaaaaacagtttaaaaagctttgcatggttgcattttcagccatttgtttatattgactcaacgtagtaccctcccggattgaatatgagcaatcccgatatcaacgatgtcagaaaggatttcctcaatatgtgtgattgtcgttctcggatttaacaaagtgaattttaagcatgttcggtcattaaccactgtttttgcaatgacagcagttcctgttttgaataatgtccgatgaatgattttattgacgtcatctgcttgatcgtcatccttaaatcggaatacaactgcattgatttctggctcaggattgatcacttcaaggtcatcatttctctcaataagcgcggccacatcctttgcaaaatgaatggtatggtcaatgatgtctccaaagccttcttctccaattaaacgaagagaaagaagtaatttcaaagcatcaaaccggcgcgtcgtttggacagatttattgacgagatgtagaataccatcgagctcgtcttcctttggattaagataatcggcatgataattgatcaaaccaaaatgtcttttatcctttagcaaaaatgccccgcaggatatcggctgataaaattgtttatgaaagtcaatcgtgattgaatcagcaagctcaataccgtctaacttcttacggtaggtttcgcttaatacaagtgctccgccgtaggcagcatctgcatgaatccaaagaccgtatggcttgacgaggtcatatacctcttgaactgggtcaatactgccaaaatccgttgtcccgcaagtggctactaccgcaaaaggcagcaagttctgctccttcaactcagccagcttctttttcaaatcattaaggtccattcgatgatgctcatctgtctcgactagtacgactgcctgttctcctaaacctaactgggaggcagattttttcacagtgaagtgagcattctttgagcaaaggattctcaggcggtgagattcacttggtaaccctttctgctgaacattccactgccatgtgttttcacaaaaggcatctctcgccagaagcagccccatgtagttagattgggttccaccgcttgtaaatgtcccatctgcttggccgccataagaaaacttcgcacataaccactcgagaatttcttcctcaaccaaagaagcaataccgctttgatcaaaggaatccattgattggttaaaagaacttaccatcacctctgcggcaagtgcaggaatgagcggtggacaatgcagatgtgccaagcatttaggatgcgatacatcaatcaaatgcggcaaaaggtgttcttttatatcttgaaagacagattcaatggattctccagacggttgaaatcggaatagcgattcgacactagccgctaatttcccaggcaatatcccactgtatggtcctgtgtctttttgccattgatccagtaagctgtcgatagatgtatgaagagccgcttggaaggactctcttccaagctggctttgattgataaataatgaatccactggagccttagttgattgcatcgtacacggcctctttaaaaatagcgatgactttttcaagctgttcttctgtcataatgagtggtggcaggaatcgaatgacacttccgaaacggcctcctgtctccacaattaaccctttgtcgaagcaattcttttgaataagactggccagctctggattcgctggatagcttccgtcaacatcctgtttctcatttggattgactacttcaacgccaatcattaaacctcttcctcgaacatcaccgagagcagggacttgtttttggatgtcttttagatgcgcctgcatacgatctcctaaccgttctacatgatcaagcaggttattttctttgataaatttaagcgttgcggttccagcagccattgccatttgatttcctctaaatgttccgatatgtgcacctggattccattgatctaaatcttgatcataaatcaccactgaaagcggcaggcttccaccaatggcttttgacagcacaataacgtcaggtacaattcctgcatgttcaaaggcaaacatcttccctgttcggccgatgcctgattgaacctcatcaataatgagtgggatccctttttcttttgtgattcttctcatttctttcatccattcaatcgatgctggaatggagcccccctcgccttgcactgcttcaaagatcatgcctgctggcggaagaataccactttcaggatcatttaatacgcgctcaatatacgaacttgaaatgcggtgcgaatccctcccaccaatgccaaatgggcagcgatattcatatgggtaaggcataaaatgaacatcaggtattaacccttgcactctttccttcggagataaattcccacttaatgacatcgtggcatgtgtcgcaccgtgatacgcaccatggaatgatagaatgcttcgattccctgtcgctgttttgactaatttaatcgctgcttctatggcatcaccaccagttggtccacaaaattgaattttggctctttttgcaaactcttctggcaagtgagaaaaaatttcattcacaaattcttctttaatttctgaggttatgtccagcgtatgcaatggtcttttttcatgaagcatacgttcaattgcatctataacaactggatgattgtgaccaagtgcaagtgttcctgcgcctgccagacagtcgtaaaactctctgccatccgcatctgtcacgatcataccttcggctttttgcatggctaatgggaaccgtctcggataagaccttgcattcgactctctttgactttgctgctccaaaaattgctgatttttagaaacggttttgatggacataataaaacactcctccaattgataaagattatcattttcatttactagcctagaggatgtgagatatgaaagtcaattgtattcaaaaagatgattctaaaagcatatgaatgctatattctctatttaacgagtaatttcgtgtcattttgacaaacctctactgctataaggagaataaacgcgtgagacggaataatgtagaaaaaaattacaaatcattcttcctggttcttttgttctattcatgacaaagcacttattttatatgggaaagtggatgaaagtgatgtagaaaaggaaaaaaagaaacgtcattctatattgatataaatggttataatggtataatttctctgaaacaaaaggggatggagagggatatgatgattttaacaaagcatgatcttcaccactacttagctcaggacaagaaagcattagccattaagcgcaaacgacctaagcggtttggagatgatatatggaaatatcaaaggattttacgaaaatatgaatactattctaatagtggtgctacaattcgcaaatggctttatcgctatttacataaaaagaaaggcatgcagcttggctttgatatcccgattggtgtcttcggtcccggtcttagaatcaatcatacgggtctcttaattgtaaacaagcatgcaaaaattggggcattttgtgatattcatcaaggggtgaatattggtcagaatcatcatgaaaaagatgtaccaaccattggggatcatgtgtggatcggcccaggtgctaagctgtttggggatatctatattgcagatcatatttcaatcggagcaaatgctgtggtaaaccgttccttccacgaggagaaaattgtgattgcaggtgtgccggcgcaaaaggtaaaagaaaaaagtccttcatcatgaaggacccacctgataaaaaagaatgataccgatcaaaacagagataagcagcatgaggtaaaacaaaatcgttaaaataagaatggtccagccaagtcccttcctctctgtcttgatcaaataaataccgagaacgatcgtactaaataatatacctaaaatggcccacagccatttgtctttatcatgctttggcgcatcaaaccataaataaatggcaacagcaagtgaaacgaataaccctgtaagtcgcacgttcaaactcctccttatgtacactcgtgctttctattatgcgtttgagtatccgataatcagcaataaaaagtaaaaaacatagactagaatgaaaatagaatagatgataatggacacgatcagaaccgcccagcccaatccttttcttcctgttttgatcaggtatattccaaatgtaaagagcccgaataaaaggcctaaaatcgcccacagccatttattcttcccatgtttaggcgcatctacaaataggtaagcgcccactataatcgacacaaaccatccggtaatccaacgcaactcattcgccatccttcatttttagattattcaatcatacgctacttttgtactaaaaagaaaaggaattattcagttgaatattgcagaaggcttttccattcctcacgcagtatcccatagcgcatcgaatcataatattctccttgatagtaacggacctttcgcagtcttccttcaaggacaaatccgcatttctctgcacaccgcatcattcgttcatttcccgaccatgtagtaagaccaattcgaggaatatcaatgtgtgtaaataactcatctgtccatagacttaacgcctttgtcccaacgccaccgctccaaaagcgcgaatcataaatgagaatgccgcattcaagccaacgtgtacgttcattctcccaataatatgacacggtgcctttgatttcgccgtctatttcaataccatatagctttggcggaatggatgtatcctgtaagtatcgttttttaaaggcagcaagcgggatttcgtgttcatgaaaatatggggcattccactttcgataggactggtctggtgctttgaatcttaaatgccataccatctctaaatcagcttcatttaatggtcgtatgctcacaagcttttccttttcccttttcatctgttcacgttcctttactttgtcgttctttttgcgagatgacggtactcgataggggtcatgccttcgttttgacgaaacagcttagaaaaataagtagggtcatcaatgcctacctgttcagcaatcgctgcgatttgattattcgttgaggcaagcaggcttttggctttttcgaccttgagacgattgatgtattgggttggcgtgagtccatataccgtctgcatgcatcttgttatgtaatcaggatgatagtgcagtttctctgccagctcttccatttgcagtttcttcataaagtgacgctcaagataatgaaccacttctgaggcgacattctcctttgcacttggaatatgaaatgcttctttttgtaaatgaatgagcagttcttcaaactgaagctgttttttcagcggcagttcagacgcgtcatcatttagtgcccgcatctgtgcaaggtgcttttcaaatacatttctccccttcacttttcctatacgggacaggctaaattcatatgttgccggcttttcaaaggtggcttgattttgtttcatatcaaaccagtgttctctcggccgattcgtcaaatcaaaaggatcaatcgaaaaatggagccactcatagtgcgtttcttcttcgcatggcaggtgtccgccatgtgacaagcctggtgagagaatgatatattctccttcttttacgtgatgagcctccctgtcttctgtgatccatagctgccctctcgtgacataaagaagatcaaacacggtaaaggttctagagatatgtctttctccttcataaaatacgcctttgccagaaacgatataaaccggaaacggcggtacagtaaatgtaataaatcgattcatattcatccccttatgaagtcggatttctccaataagtttcggtttcatctcttcttattatagtcgatgcaaggtacactataaatcggatttatacgaaaggaggttgattgatgaaacctcaatcactgccaattcaaaaagttcaagctagagggaagaaaaaccacccttcattatttgcattaacttggcctatttttattgaaatctctttatatatgctcatgggaagcgctgataccctcatgctcagccaatattccgataatagtgttgccgcagttggtgtaagcaatcagctgctgaatttattgattgtcatgttcagtttcattacaactggaacgacgattgtgattgcgcagcttttaggagcaagccgcaggcaggaagcggctcaagtcgcctatgtctcactaggaaccaatttcttgattagctttgttattagtcttctcatgtttgtattagctgtccccatcttacatctgatgggcctatcaagtgagctcatgccggatgcgactgtatttttacaaattgtcgggctgctttcttttattcaagcgctcattatgacgtatagtgctattttaaaaagctatggatatacaagagatacgatgtatgtcaccatcggaatgaacttgctaaatgttgctggaaactatttggtgatttttggtccgtttggcttccctatattaggtgtcatgggggtcgctttttcaacctcactcgctcgattgatcggattaatggccatgatcctcattgtacgccgccgaattggattacacttttcactaaagaagatgtttcacatccagcggacatatttaaaaaagctgctaaagatcgggattccttctgctggagagcagctttcttataacggctcccaaatgattattacactatttattacatttatggggacgcaggcattagcagcaaaggtttatactcaaaatatcatgatgttcattatgctatttggtgcagccattagccaagggacacaaattttaatcgggcgccatattggggcgaaggaatttgatgctgcctatcacagatgcatgaaaagtttatactgggccattggcatctcccttctttcttccactgctttatctttatcatcgacgcatttgcttgctttctttactagcaacagcgagatcattcaaacagccgccaccctcctccttttgaccattattttagaaccgggccgttcgtttaatatggtcattattaattccttgcgggctgctggggacgcgaagtttccagtgtatatggcgatgatttcaatgtggggcatcgggcttccgatcgcttacttgttaggcatacagcttgagatgggcctcattgggatttggatttcttttatcgtggatgaatgggtgagaggcatctttatgtataggcggtggcgttcaagggtttggacggaatatcgcttttcatccacataaaaaggactgcgagtgcagtcctttttacttaataccttctaaaataagtgctttttcttggtttgaaataaatgatcgctgtgtaaatacgcggtattcattttctcttgttttatctaaaatggctttataaaagtgagcagctgctttcactggtatacgtgaataaagcgggaattcatgaagatggtcaaaaaactcctcgtagtatgcctctgcctcaaaggcaatgtactcccatacgtgctgaaatgcttgattgacaatgccttcttgcaattcttgctctgtatatccgaattgatccatgacttgctttggcaaataaatgcggtctctttcagccttatcctcgccaatgtcacgaagaatattggtcagctgcatggcaatccctaatgaaatcgctgcttcttttagctgttcttttttacgcggtgcaattataggaagcagcataagtccaacggtactagcaacatggtaggaataaatgagcagttcatctaacgtttcatatcgatgctgctctaaatccatctcctgaccttggagcaagtcacggaacggtgcttcatccatacgaaaatcttgaaatgtatgttccaacgctacccacatcggatcattccgatctacctcaccttgtaaaaatcgatcaaacgtctctcgaaaggaggcaagctcctcttttggcgagggtgactcatctacaatatcatctgctcttcggcaaaaggaatacacggcccatacagcctgtcgtttctttttaggcaacatggaaaaggcacggtaaaacgttttggaatgcgtttgaatggtctcctcacacaatttcaatgctgtttgtacatcaaccacttagtttcacttcctttctgtcattcaaatcttttaacagcaaagatgtcatcagcttcgcactttgcatcacgatcggcactccgccaccaggatggatggaagcacctaccgcataaagattatcggtctcagctgccttcacttgcgggcggaacacacctgattgaaataagttaggcgcaagtccaaagctgccgccttcaaacaacccttcccgcaaggaatcatttggtgttctgacttttttccagacaatcgactctcgcaatctcggaaagcctcttttctcaagacgatccatcattttctctacaaaatctgtctcctcttcccagttgatatgatctcctgagggaacgggaatcagcatatataaaacactacagccttccggggcaagagatggatcaatgatcgatggattaaatgtataaaacgacggatcttgagggatcgtcttcgtttgaaaaacctctttcatatgctgttcaaagtgttcgcccataaagaattggtgaacaggcgcatcatggtacattttgtttaacccaagatacaccatcacacaaccagaagatggcacgtattttcgccgatcttgttcgtctaaactaagctgttttaacgcagccggataatctccgttgatgacaaaagcatcagctgctatctggtcgtcaatgacttttgctttaaccacgcgtttcccctcaaactcgagctccgtgacttcagcattttttctcacatgcacacccattttcatgagctgttcttctaatatatctactaaactcgcatagccgccttttaaatagtagatgccatgtgcgtgctcactatatgaaacaagcgaataaatagcagatgcttcatatggatttcctccgacatagagggtttgaagtgcatatgcatctcgcaggcgttcgtctgagaaatactttttcagagcactttgaaccgtgcgatacgcctttaatttcattaaaatcttcatatttgcttttgtaaaaaatgtccgcttttcatgaaatgatttctctaaaaaggcttgctgtccttcttgaaaccggtctgtcatttcttccataaaccttaggaatccttgatcttcctttggaaatacacgtctgatttcctctagctgacgaagtgcatcagaatacttcgtgtaggaggttccatcttgaaattgaatcgtatacagcggatcaagctgcaaaagatcaagagatgcttcgtcaattcctacctcatgtaaaataccttttaacatagctggaagtaggacaatggtcggaccttcatctactttatatcctttctcacgtacaaaagcaagtcttccgccaagtcgttcatttttttcgacaagcgtcacatcatgtccagctttttttaaataaagtgccgagatcatcccgccaataccgccacctgcaatcaatatatgttttttcatgaggcgctccccttttcttcttgcggcaatgttttgtgcgtatgtttctcttttgaaagaatcgcatttgtcgtgatacgtgctgattctaaaatggtcggcagtccgcttcctggatgcgttcctcctcctacaagccagcaatgatccaattcatcaaattcattgtgcggccttagaaccatcatctgcgtcagctggtgaccaaggttaaaagtggctccttcgtatacgtaaaggtcttcctcccattgcttcggtgtgatcatccgctcgacttctatatgctgccttacattcttaaaaccggtttttcgctccagtgtatccagtacaagttctctgaattcatcttgatgcgcttcccagtcaatgctgctttgattattggcaacgggtgctaatacataaagagctgactttccttttggcgcaagtgagtcatctgtgacactagcattttgaatataaatagatggatcatctggcagctcatatgttttcgtaatgcctttgacgaattgcgcataatcatcagaaaaaacgatggtatgatgcggctcctcatacatggtatctaaccctaaataaagcataaaggtcgagcatgagaattttttcttttttaattttttctcactatatttctttaaaagtcctggctctacaagctttgtcattacatgtgcaaaatctccatttacgacaacctcatctgcctgtatttcttccccggattctaagcgaatgccctttactttcctgccttctgtcagcaacttttcgacgccggctgacaaatgaatcgttgctccagcatcaaccgctgcttttgccatcgcttctgacagctgattgaccccgcccttcggatggaacacacctgtgtcatgctccataaatgatagaatggaaaaagcacccgggcattcccacggtgacatgcctaaatactttgattgaaatgtaaaggcatatttcactgattcatttgagaaataatctgacagcacatcatataaactcttattcaatgaaagctgcggaagtgctttgagcacctttggacgcaaataatgatgaaaacgatccattttactttgtaatataggtgtaagtcgatccattttgcgtttcgtatcgttcataaatcgtatatacccttctccctctccaggcgcaaaggcttctaaccgtctaaccatttcatcacgatctcgtatcatatctagctgatcgtcttggaaaatcaatctatacatttcttttaattcgatcacatcaatatagtcataaagatttttaccagcaaaggtgaacagctcctctgcaatatgaatcatgctgagaaaggtaggacctgtatcaaacgtgaaatcaccaagttgaaacttagaattacgtccgccaacaaagggctgtttttcataaacatgaacatcgtgtcctttgctttgaagcatcatagctgccgcaagtccccctggtcctgctccgatcacaatgattttcattatcctttttcctccaaattaattcactttaagttaattatacaaattagaaagattagatcaactttcgatgtgctctatttgtctcatgttatgcatcaaaaaaagccggcttcccttcaacaaatgtaagaaagccggccctttattacgcttctatatcaattcgatacgtctcaaaccagtgatgaatctgcgccagatgagcgattaattgcgggcccttcatgagctggccataccaaggtacttgaaaggaagctccttccgtttcaatcaactgctttaattgatgtggatctagaaattcgtgaagaacagaatctttttgcgcaaggcaacctgttaacatctcttttacagcctgagtataggctggatgatgtgttttcgggtaaggactcttcttgcgataaagcacttcattcggtaaaattccctctaatgctttccgtaaaacccctttttcacgatttccatgcattttcatttcccaaggaatattccatacatattcgacaaggcgatgatccgcaaatggcacacgtacctcaagactcgcccccatactcatccggtcttttcgatctagcagcgttgtcataaaccagaccatatttaagtaaaaaagttctctccgtgctttatctactccagtttctccatctaaaagaggcgtttcagccacggtttcttcatatttgctttgtgcatattctcttagtgacagctttttttgccacgagtcttgtaagagctgcgttctagcttccgtcgatctcatccaagggaaaccattcgtttcatttgccgaatggaaccaaggatagcctccaaaaatttcatccgcacattcacctgacaaaccaaccacaaagtcctttttaatttctcggcagaaccaaagcaaggaagaatcaatatctgccatacccggtaagtctcggacctcaaccgcttcctttaaataagcagccagatccttttgtccaatgatgcagctgtgatgattcgtttgaaatgccttggtcatgcggtcaatccatggaccatccgcattcggctggaactgacttgcttcaaagaattgatcattcccttcgtagtcaacggaatacgtatgaagcggtgctttccctattttctcaaagtgcttagcggcaatggcggtaatggcactcgaatcgacgccacccgataaaaatgtacaaacaggcacatcagagacaagctgccttgtgacggcatctgtaaagagatccttgacgtgctgtgcggtgtcatcaagtgagtccgtatgcgccttgctttggacattccagtatctccacacacatagtccgtcttttgaaaaggtcaaggcatgagcaggtctcagctcttttacccctttaaacactccttgccctggtgttctagatggtcctaatccaaaaatctccgataatccctcatgatcgacttttgctttcatatcagggtgagcaagaagcgctttgatttctgaaccaaataaaaaggaatgatgacgttctgtatagaaaaatggcttgacgccgagccggtctctccctgcaaataataattcacgctcactatcccaaatcacaaatgcaaaaataccattaaaatgggtcacacactcttccttccattctgtgtaggcgtgaagaagtacctctgtatcagaatgcccaaggaagcggtggcccctttttaacaattcttttcttatatcttctgtgttatagagctctccattatatacaacggtataagcatggttttgatgtgtatatgtcatcggctgttttccgccttctacatctacaaccgctaaccttttatgcccaaatagaacgtgctcacttttccacgtatttgtatcgtctggccctcttttagataatgtatctgtcatttgattgattacatgatcctgttggatgagctgctttttaaagtctgcccagcctgttattccacacatcatcatcagctcccatccgtttttcctcaagtgttctcattcagcctttcttagtttatgcatcgtctcctcgatagttgatttgtccttttttctcgggcgtataggacaagcttgatttggtaagaaaaagaaagaggaaaggagcgtctgcaaatggaaaaacgaatgaagcagcttgaacgctgcagccgaagatggtgtagcgggtatttactcattgaaaatgggcattgtctgattgaagatgaagaaggagaattcatgctgccagaaagtcttcaaagcacgatgatctgtttgaaggagaatgataggtggataaaaggagagctgctcggttccatgatacttcatgaaaatggacagctgttagaagtacaaggcggtgaagaaattcaatatacggcatcactcgccaaaggcttgcttgaccttctcatgtttgttcctgaaaacgtcttttatgaaatcattgcacagatcgagcagcttggcttttccgtctatgattgtgttttctcctcctttcattcttttcaacgagttactttctttcagttttcgacagatacacaatcgcttgcccttcaatctcaccacgactcaactgcaggtcaaattcggtttgaatggaccacttctgacggtcaccggtcggtttcacagtttgatggcatataaaaaggacactgcttcgtataagcaatgtcctttttctgttaaaagatatgaaaaccaatcggcagacgtaaaccgagaagaatggtcacgatcgcgagtacgataaaaccaatcaatacaccagtcaccgattttccttttttcttgcgtacaagagtcatttccatgaagccaatcacaaggataccgagaatcattttaccgatatactcgccaccgaaacctggaatcttcattcctgtgcgaacatacagctctacgcctgtggcgataatgatcaagtacaatagtctgacaatcatgtgcacaattttagcacctttatcgtttttacctgctagagcaaaggccacgaagaataaaataattcctagcacccatgctgtaatatgtaaatgcgttcccatttgttatttccccctttatcagaacaattaccttctcatcgtaccacgaaataagtcgaacacaaaacgacaatcctgtgtcatattactctttatttgacgcgatttgatagcgttccaatcggttcaatcgtaatatcgatttgatcccctgaagctaagaatttaggcggttcaaagcctttgccaaccccagaaggtgttcccgttgcaatgatgtcaccagcttctagtgtcatcccttttgaaagagtagacacaatgttctcgatggagaaaatcattaattctgtacttgcagactggcgaacctctccgttaacctttgtttccacatgaagcgcgctatgatcctcgattacagacttatgcacaatataaggtcctatcgggcaggttgtatctaagcttttccctataaaaaattgtttgtgttttttctgtaaatctcttgccgttacgtcatttaaaatggtgtaaccaaatagataatccttgacttcttcaggtgcaatattctttcctgatttgcccatcacgatcgcaagctccccttcataatccagttcactcgtcacatcttcatgaaggaggatatccgcttcatgtccaacgactgaagtaggtgcctttgtaaagatcatcacatctttaggaatatccgctgcacttcccatctccatgacatgatcttgataattctttccaacacacataatgtttttagctggctttggaatgggcgcatggagtttcacgtccgacagcggataaacataagaaccgcggtcttcttcttttttctcagcccagtcaaggagctgtttgacatgctcaacaaacttgtcccccatatgaatacattcagctaaagagttcggcagtgtctctagctcgaataatttggcttctgcctttttgacgtccatgacccattcatcatcaatgactaccccaataaacatcctgctatgtatctcacctgtaaaaaacttcatgtcttcccctcacaatcttcatttcgctaagtggtgatgtctcattttatttctctatgaaataaaaaaaacccttttttatcatactctcttttaaaaagggtttcaaaaaagatgatctgatgtttagcggtagcggcgatactcccacatgttcccttgatcccatttacgatcaacatttcctctgctgcgggaatgatgctttttctttccacatcttttgcaagagtggctgcggcgcgacttgtggctcttcttatgatgggatctgtgcttgctgcgatgtgacttgcggcagctcttcttatgatgcgatctgtgcttgctgcgatgtgacttgcggcagctcttcttatgatgcgatctgtgcttgctacgatgtgacttgcggcagctcttcttatgatgcgatctgcatttgctgcggtgtgacttgcggcagcttttcttatgatgggatctgtgtttgctgcgacatgattttttcggttcgctctttttgcttctgcaagattttttgcttttatatgactttttactcttcatgcttttcttcgagcgataacttttctttgaacgatagcttctgtagctttttttactgcggcatgatttacggcgtccaccaccgccaaagaaccaatgaccgcgacttgaatgacgagaacgagctgacttatgcgaacgtctcgattctggttcacgatctaagtgatgatcacgcccctcacttttaagtgaatccactgcatgctcaatatgtgaatgatcaaatgtgctcacgaacgattcccctcccagtctatactttgacaaaacaaacagatcaagctgtttatcttctctgctttatgttacgagaattgatagacaagtgttcttggcggatgcccctttcttttaaaactccatgaatacctaacaaacgggtacaggacattccttcattttcatatcgtaaagaagagcaaaggaggaggatgaacgcatgaccacagaacctttaaagcaaatggatatttggattcatccaaaggacctgattgaattaagaaaagacatatggaacgacgaacctgttgagggcattttgaaaactggccagatcaaatcacacatttatgcttcatatcgggggtctcacatcagaaagctgaaaaaaaagtcctatcaaattgaatatcgaaagccaaagcaaagacaaggcgaatcgatctttcatttaaatgcagaatacaatgacccttcgtttatccgaaacagactgtccttttatttcttcgagcagataggggtgctaagtcctgctgcggctcatgtgtttctcacgataaacggaagaaaagaaggcatttatttaaaaatagaatccgtcgatgagcacttttttcagaaaagagagctttcagaaggcggcatttattatgcagtcgatgacgacgccaacttttctcttttgagttcatttgataaaaagccaaaaaaacaccttctcctcgggtacgagaaaaaaacagggagttctcaacatgatcaacagctgagtgaatttatttactttctcaacacagcgaaagatgacatatttgccgaaaagattgggcattacctagatgtgacccagtatttccgctggctcattggtgtcgtgtgcacacaaaactttgacggctttgtccataactacgctctttatgtgaatgaacaaggcagattccaagtgcttccttgggattatgatgcgacatggggccgtgacattcatggagaagaaatggcgtttgattatattccagtaagcggctttaatacgttaactgctagattactagatatccctgcgtttaagagagcctattacacgcttttccagcacgtactcgatacacattttttagaagaccggctttgtccaatcattgagaaatggcatgcttctattgagaagcgaattggagatgatccttatacaagagaccgaaaagacattctacgatcagaacgagagatcatccggcagtatatcaacaaaagacgacgttatttacagactgaaataagaaaagagagagatgtcacgtaaggacgctttcgaattttgtcactttattactcatattgacgaaacaactttttttatagaaaaatagggtatactaaccatatccttctatttgataaaaaatgtgagagttggcgtccgttatgatcaattatgaaattgaacaaaaaagattacatttaattgagaccgcaaaaaaattcgggatgaatgccgaagaaaccatcaggtgcagtcaagagcttgacacacttttaaataaaggcatcaaatacacctcgaatgaatgctctaaaaaagggtaaaccatacacctcattcctctcaccaaaagctttcaaaaagacaatcacacattaaaagacccatcataagctatggtgaaacgcccaaaaacaaagtgccttatttttataaaggatgtgcaccgctatgccggctattgttggagcctttaaagtaaatgccgtcggaacgagcggagtcgttcatgttggagactgcatcaccatttctccaaatagtcaggttaaaacgtttgctggcgcaggcagttttaacactggtgatcaattgcgcattagcaactataaaagtgtgacaaatacgtatgatagtgatgtcattgatcaaccgcttgttggtaacttgtaaggagtgagaatccattgaacttctatattaatcaagcgatacaaattaattacttacgagtggagtctgtgagtaactcatccgttctgcaaatcggaagtgctggatccatcaaggcattatccaatttgtataacactggaagctacgtagaatcagcacctgccgcagcaggcacacaaggcattgcagaatctcaaggcgcaaccacgacaccttttgtaccgcttcagtcaccaacaacataagttcatctgcaatccccggaggtgtatgcatatgtatgactatcaaaacaacgcttcacaaatgtatggcatcattcaaaagcaaacacagcaaatcatgatgcttgaaaaaaggcttaatgagcttcagcaggaaatgcaaatgatcaaagataaaccgacaacaacaattgaacggattgattatcaatttgatcaactgaaaatcgagcggctggaaggcacattaaatatcggcctcaatccatctgatccaaatagtgttcaaaattttgaagtgggtcaaacaacaaccccgggaattggaatgatgcagcaagaaatggctgatcaatttttcaatcaaacacgccagcttgtcgatgcattcttaaatgaagaagcaccacagcttcttgaagaactagagcagcgatacgaaggctcgcttgatgaaagcaacaagcaccatatcattgaggacattcgaaaacagatagacagcagaatcaaatattacgcgggacagctgccacaaagggaagatatgacaccacttcaacgttccgagcaaattgctgaatatgtgaaacatgatgtcaaacgggctatcgaacactttttagcccatattccaaatgaaacgaaaggagaggaaaacggatgaatttcacagtcgtcaaccgcaacatcgaaaccggaagcatcaaagtagttggggtatcgtcctcttccctatttattatcggggacacagaccatgtacaattgtcatcgattttcgatacaccgccagaatcattaattattggcccgtttgttcctctatcccctcgataatgataaagcgcacatctcaagtgaagttctcgaaggtgaattctgtggggatttcgagtgtggttcaaattggtgatacacaagagttatgcccgaacgtgaaggtgttagctgttcagcgaacgattagtttgttttatggaaatgaagctgaaaacctagatgcaaaagaatttgaagtgtattatgagccaatcccattgatgctgccagaacgaaaagttagaacggccttttatcatgaaaagcctctcattaaagtttcgtcaattcatgtagaaggggtctcttcctcctctatctatcaaatcggctctacgtgcgggataaatgccgttgcacgagtaaagcatattcgagagttatttagcaacaacgacgaaaatccgccaaactcacaattggacctccctgcgcatatgatggtgatatgacttcgaataaaggatgtcgattatgccagcaattgtcggacccatttacattaactcgatttctgggggcgtcgtaaacgtcggtgactcattttatctttcgcctaaaagttcttcaaaatctgctttaggctctggagcggggaataccggagatttcttgattttaaataatggcattagcgccactaactatgtggatcctgacttaaacgatcagaatatggtaggcaatgcataaagcggctcctctacatccatttcacttagaggagcgcttttttatgtttatttctttctacgttgtcttgatttctttgttttgaccaacttacttgccggctgctttcgaatccatttgatgtacggaacaagcttttcatcttgtctaagcgcatcaagcgtgttcaaacgtgcggcaagctcctgatttgtataaagagcatgtacttgtttatggcaagggatgcacaggaaggcagtcggtaaaaaagccccaccttcttctcttggtgttaagtggtgttctgtgagcaggacattttgtcttccgcacagctcacataatccaatggtttgctttgccaccctgtcatcacctcaacatttacatcaattccattgagaccgttgtccctttcccgcttggatctgctggatggacaatcagtttcttcggtagcctcattttcaattcttccacgtggctaataacaccaactgctaaattgtgagactgaagcttttctaatgcggtaatgaccgtatcaagcaagtcttgatcgagcgtaccgaatccttcatcaaggaaaaagaattgcagcgggaattcacctctcagctgaatttgtgcagaaagagcaagggcaagagccagtgatgtcaagaaggtttccccgccggacaagctggacacgggacgcctaacaccgccatttgcatcatcacgcataacaaagccgccttctgagtcgacctcaatcgcatatctttgtctcgtcaacatacctaagcgggcggatgcatcacgactgacactttccagctgttcttctgctaaaaattcaacaaacgtattccctttaaaaacagtttgcagtttatcaaggcgatcaatttcttgctgcagtgcttccaatcgttcgtgaatacttgcaaagcgctgatgattctcttccatcacacgcaggtgttcatgtgcggacccactcattgcagtcgcttcttccaatgctttttcagctgcctcttttctgtgctgaatgtccatccactgcttttcatccagagactcttctttcaataattcagaaattcgctttaagtttgcggcacattcctttcttttatcctcaaattcctcaatttcttgtttgaccgattgacgtactgcttgttccattgaaacagactcaatttcctgcggcatatgaaaaggagaagattctgctgctgtttcccaagctgctgctgtttcttgttttcgcttgttcgcctcttgaagctgacgctcactgcttgaaaaatgactttgcgcctcactaaacaactgctgcgcgtgctgcaattgcttgtacgattgctgctctttttcattaagaagagaaagggagtgttcaacctctataagttcatcagaaatagaggcagcttttaatggatatcggcctaaatctatttcatattgttggataagctgctgttgactttctaactgatgcgctagtttatcaagttctttctcgacattgtatatcactgtctgcagctgttcttttgctagctgtttttcttccaaaaacgaaatacttttctcaattcgttctttatagccttccgcttgttggtccttttcatcgatttgcttttgcatttcttgtacttgattcaatgtaagatgcgggaaggtctgttcaaattgagtcgtttgctctgaaagctcagcatgaagctctttgatcagcacttctaattcttcaatgcgctgctgttcaaaagtcatttgctctttcattttgctcatctctgctgattgatcatgcgtttcatccattaaacgagctcgtttctgttcaacttcttgaatatcttgctttatgcctttccattcttgcatcagatcctgcaaagactgcgaattttgtaccatttctactgctgcagcgacttccgctccaggggctttctgagataagaaagcgaattgcttcactaattgattggcatgcgtttcgagaagctgctttgcggcatacatgtctcttccataatcctctgcctgcttgagctctttgtccatccgttgaatgacttcatcgacttgtgccacggtttcttcatggtcattggattgcaaagcctttggatcatgatgaatcgacccacaaaccgggcatggctcaccatctactagctctgctgctaattcttttcttaattctgccgctcttacagcatctcgctgctttaatttttcgagtttctgttgttgttctttttgactccattctgtcagagctcgttcgagttcacatacataaaaatagaggtgttcaattgcttgaaacgattggtctattttttcatgatggtcgttttgctgcttttgaagcctttcatatgcttctgaagtctgtgaggctcgcttgttgaactcctccagcttttgcttttccttttgaatgctaaggtttattctttcaacattttcacttaaacgtaaagcatcctgtacacttttgcgttctttcactgaaacttgtaactgctccagctcattcttcagctgtgtttgtttcgttagtgcacgctctaatagagattggagattctccgcttctttcttcttttggaggagctgctgcgctttttcatttttttgacgctctatgcccgtcttttcctgaagagctgcctcttttttacgttcaatttcttttagctgaatcagctgctctttcttttggagaaggtctggctctgtctctattttcttttgccggtcttgctcatactcccgcgccatttgatcatagatcgttcgttgatgcagcagctgcttttctgcttcctgcttctctttcgatgcttgagaaagctgtttttcagcctttgtcaatgcatccgcatagggctttagcgtctctgcctgctctgcgatatggagcttcgcccttttctcttctattgatggtgccagtaaattcagcttgttttgttcagtctcgtaagcttcttgttccttttgatactgccagatcgtttgcgcctttgtaaaagcagtgagcgcttcgtcccgcgcttgttttttctcatgaaaaatagcctttgcctgctctgctgcttcatttgcttttgccagcgcctctgggccagcttctcctaaaccattcagttcagccagcagttcatttttttgtccataatgcttttgagcctttgcacgcaatcgcttgacgagctgatccccatatttctccaagttaaacaaccgctgaagcatttgacgtctgtctgccccttttaaggagagaaattctgcaaacttcccttgaggtaagacgaccgcacgggtaaaatcatcaatggttaatccgagtagttcttctactttacgattcacctcactcgctttatctgcgagaactgtctgcgtatcaccgatttcaatcaggcggcataaagtcgttctgactttcatttcatccgctcgtttgaaagcacgctcgactttataagaaatgtggtgttccttttgcaaagcaaatgtaaaggaaaccgacagcttttcttccgcttggttcaaaataccatgtgtattatttaacgcacgctccactttgccatagagggccagggtcatagcgtctaatatggacgactttccacttcctgtcggtccaaatatgccaaacacacccgcatcacataatgagctaaagtcaattgtttgttcttctctgaagctatgaagtcctttaatggtcagcgtaatcggcttcaagtcgcttcctcctcttgcatatcattggctagctctaaaaacagtttgactgttttttcatcaggcagaccgccacctgtctggcgctcataaaacttcacgaatctctcttcgatcgagagtttttccacttgcttttgctcttctatttgctgtagttctttgaattttggacgaatgtgaacaaacccactatgctgctttcggagttgatgaatctcttcaatagagagctgatctgttaaatgaatctctagatcaatccatgcctgaagatctcgtttttcatccagccactcgtacacttgactcagtccctcagtcgccttccatttcataagtggttttccgcttgataaaaacacttctttccagctcgctttttcattcggttttgcctccacaattgtgactgatttggcatagcctgattcagaaaagctataagcaagaggtgatccagaataacgagcaatcgttttggcacgtttgatcgtttgcggcctgtgcaaatgaccaagcgcaacatagcaagcggattctggcaggctttcagccgcaacggtatatgcgccgcctacttcaatcggtctttctgaatctgtttgacttcctcctgccacataaatgtggcttgttgcgatattgaccgtatccggttgaaattgagtacttaaatgttgaaacgcttgttgaatctttaaattgtaatgatcacgaagcaatttctcttcgaatgtttcagccagcacctcatttagcctcgcctcagacggataagcgagtgctgcaatggataaacgttcatccgcagaagaaacatcgacacggatgatgtcatttgtcggatatccaattaaatgaatcccttgatcatttgttaaaggagatgcggctgataagcgatccggattatcgtggttgcctgaaatgaccactacctggcgttttcctttatcagataaagcagatagactttcataaaaaagctgctctgctctagcaggcggattcactgtatcaaaggcatcaccggccatcacaatgacatcaatgtgttcgtctttcacgatttgatacagctcatctaaaaactgtgcttgctcatcgagccggcttcgaccttcaagggttttccctaaatgccaatccgctgtatgcagaatcctcatgtgattcacctctcatttcgatacatttataaagagatttctaaattcccatcgaagaaataaagaattttctcctctaatgttctgtttgtcaaacgctctacagcttttgcatataatgctatttgggtttcataacgctttttcaagatcgattcagcagcgtcaactgtatatctgccttgtactctatcagttttataatctagtaaatatagctttccatctgtttcaaataaacagtcaatcattccttgaatcagaacaggctctccctcagtatctatatgacggtatacctctttaacaggtaacaccatactaaaagacacctctcgtttcacccagtccgcttttagcagtttttggccaattgaagtagagaagaaagatgcaattccttcttgattaattgaccggatctgctcatctgttagcaaatctcgctgctgtaaagattcgagcaagtgtcctatctgtgattcatcataaggctcctcagaaggaagcgggatatgctgcatcactgtatgcattgcggtgccttgctctgcggcagtgagtgtttttttcttcatgaaagccggccggtcatacaatgttgcacgagcttttcgaatagaagaaggaacactgtactcatcctgtatttctttcattctttttatctcggaaacagactgctttgtgccgacttgcgaggccgctagatacggatatttccatgagagcctctctgccaccttctcatcagcatcaccatatccttcaacaggcagaccatccatcaatgcttgtacaatctcgtcttgctccttcttttcaagtgacatatcttcctttaaaagatcagaagcttgcgtaaatgagatagtgaatgtagacggatgtgaaagaacaacatctcctgcttcttctaaaacagatgccatcgcttgatgacggatgagggcaggtccaatgaaatctaagtatgtttttgattgataccgttcaaaatcagggagcagccactcttctccggttgcggcattttgccatttacttaatgctttcacctgatttttgacagagccgaccagaaataatttttctttagcccttgtgagtgccacatataggactctcagctcttcagataataactcttttctcatcttttttttcatcgccacaagcggtaatgtcgcataactaattctcagttcaggatggatgtacttgcttccaaaccctagttctttatcaagtaaataggactggtttaagtccatcatattaaagttcctgccgagtcctgcggtaaagacgactggaaattctaaccctttactgctgtggatcgtcatcatacgcacaacgtcctctgtttcactgaacgtttttgccgcaccaagatcatccccacgctcctgcattctttcaataaaacgaaggaatcggaatagccctctaaaggcagctttttcatattgcttggccctgtcataaagggcacgaagattcgcctgtcgctgtttacctccaggcatcccgccaacataatcaagatactgcgtgtcacggtagacttcccaaattaattctgccaccgaatgattgatagaaaaatcacgccacttgcgcaggaattggaaaaatcgctctagctttttgcatgtagggtgatcagaatgcgtcacactcataaatgcctttacagcatcataatacgtgccttttttatcacttgttcgaatcagagccaattcattttcatctaaatgaacaagaggtgatcttaaaacagcagcaagcgggatatcctgatatggattatcgatgacttttaacaaagaaagaatgacagacacctctgttgcttcaaaataaccagaggaaagattcgcatatacggggattccctgcttctttaattcctccatcatttgcggagcccacggcatagaccgaagcaaaatgacaatgtcacgatactgtaagttacgggtcatttgctgctttgcatcgtacacttgaaatggctgctccactaattcttttatttttttagaaatgattctcgcttcaaattggacggtctcgagctcttctcgctcttcgccggtttctgcttcctgctgatctaagtggacaagaagcatttctgtcgttgtatctttgctttctggataactcgctccaagctttaattcagcttgttcatcatattcaatttctccaactgtttcccccatcagctgcttgaacaaaaagttcgtactatctaaaacatctgaacggctgcggaagtttttatttaaatcgattctcttccctgtttctttgccgtctggttgaaagtgtttatatttgtttaaaaagagcataggctctgccagcctaaaacgataaatagactgctttacatcaccaaccataaacagattgccctctgcagaatgttctcctttagatacaagctttaaaatggtttcttgtacaaggtttgtatcctgatattcatcaacgagcacttcttcaaactgctgttgatagtacttggcagcttctgtttcaatcaaatgtccttctgcatcctgctccgctaaaatgcgtaagcaatagtgctctaaatccgaaaagtcgacaattgacttttcctgcttcgctctttcaaaacgctcaccaaattggatcacaagctctacaagcgtctccacaactggcttcatttcagctaagctttttaaatgctgggcaggactgcgcatgaagtattcatcttttagtttttctaattgttttttcgcttgattacgtgcatctgtggctttttctaataaagcagggtcatattcgtcccctttgcacgttttgagccttttaaaattgacgttcggcaaaagctcataaagtttctcaaaatcatcttgatgacggattaattcattgacttgctctaaatcatctataaaattctctgctctcggtgctgggccacccggctcttttgatagcgaaagagctcgttcaagcagctcctgacagctccggagaacgagagaaagatcttctttgatatatggataaaacggtaattcttctacttttgtttgagcatctacatcataaagtgaaagaaatgcccgcatccattgctccggagatggatgagatcttgaaaactcataaattctcttcacgagccattgcaaatctaagtcgtgacggtcagacgtgtaacggtcaaccagttcaaagaatgatggctttccagccttatattcatcctcaaacagttcatctaacacttcatctcctaatagttctccttctgtttgatcggccaaacgaaagcctggatcaagatcaatttcatagtaaaaggtgcgcaaaacctgcaagcaaaaggagtgcaaggttgaaatattggctcgattcatgagggacagctgccttctcatatgaagagacccagggtttttggctaattctttttcaagtgcttctgtgatccgatgcttcatctctgccgcagaagcatttgtgaaagttacaacaagtagacggtccacatcaactggatgttcaggccgggtcatttttcgaatcaggcgttcaaccaaaacagctgttttacctgaccctgccgccgccgcaaccaagatatcttgtccttctgaaacgatggcttcccactggtcatccgtccacgtactgttattcggttttggtatttgcatactgatccccttcttttttgatccggtctatcacaacatcgtccttttcagaggtgagcactctaaaatcattatcttctattgattcatcgaattggcaaatagacttgaaagaacaaaagcggcaaggtgtttgatcctttaatttatatggattaattgtgacctctccatttgtaattctttcgcctgcttcttcaaatgtacgccgaacgtgttgtgtgagtatatggaaatgatcttcacttaaaactgccgaatcagaacggaaagacccatcctttttcaagccagcttgaatgacttgcgatctacctgaatcaagcgtttgatccattagctttactgcttccacatcttcaagcaataaacccttcattttaaatttcttgtatatttcctgctcaatttcatcttctgcaagcggaattggtgcttgaatgagcggatcatgaatatggaaatataaaatgccagcaggcgttgcttctacgccgagccactctttcgaatacgtaatggttaggtctaagtatgtgagcatttgcaaggcaagaccatagtatacttctgctaggtcaagacctttctcactggatttgtaatcgacgattcttaaaagcagcccttttgaaccttctgctttatctaccctgtcaattcttccgacaagttccatcgtgcagccattctttaattgaaaagtaaacggcggcaaaggtccttgccccccgaaacctaactcaagccctactggagaaaatccactcactttggcatgttcacttaatatagaagagactcgaattaagattttctggagcttttctttaatataagcatgccgattagagcttaatagaatttccttttgaagacgcggagcaagctgttcgattgcatgtcttgaataggtgacacaatcttccttcgttaggtttttccaatcctttttttgttcaactagcgtatctgaaatatgcttcaaagccgagtgaaacagctggccgatatcgggtgcttccaatttgtaaaattgtcgatccttaagttttaaaccgtgggaagcaaagtgagaaaatgcacacgcattgaatttctccattcttgaaacactgccctgaatatgatcaccgtaaagctcttttgtgacatttggctttaaaggcttcgctcgatttgtaaagaacaaacttgacatgatgttttttgatacatcccgattaggagatgtcattaagtagttatagacactccaccatacaccgctaatgggatattgattgagccattgctgcagctgtgagacagtatacgacaacgatacatgctcattcgctacaaattttaattgctcattgtcttccagctgttctggatctaatacataaagagcctgctgatgatttggcataagctcttggcaatacttgatgagtgttgaaggcaataaagaacgtccttctgcatcagaagccgcataggatagatacaaatgatgggatggacttgataacgcttggtaaattaaaaattgctcatctagcagccgttcttttcctgtctctgccagctctgctcctgctcgttttaaccattctcggtcatcctcagacaatacactctcatcagaggggcgtgcgggaataacgccatcgtttacaccaatgataaacgtacacttcacttgatacattctggataaatccatacttccgataaatacttgatcgagtgaaggcggaatcaaagcgaattttagagaagctaatcctgtatctatcatctgttggaataaaggaaatgagagctcttcgtcacctagcatgtcaacaaattcatccattaattgaatcacagcatcccatacttgcccgtgctgcattgcttcagctaatcgacctgcttcttcagcctcaagcctcgctttttcaagcttatctggtacttgtatctcttctaaaaagacatagacagcctctaccatgtcccttaccttttgtgcatttttaagtcttttctgcaactggtaaagcgggggcgcgatccattctttgacatcatttagcatttgttccatttcgatttcttgatctgtttgcctgaaatcctcatctaatgattggaagcgcctgtaatgaaaccgggaaccatttgtccagcgctctccttttacaccataagcaatacaatagttttcgagctgatctgcctgctctctcgctttgttcttagtgatttcaagcggaaataagaactctgttttcacgcagcgaaataccgcctcataccgccaatttccttttatgacatccaagctcgaacgaatcaattcaatgagcggatgatactgcatcgattcatttccatcaataaaaaaaggaatgtcgtaatctcgaaaaacctcttttaacgtatctttatagtcgtctacatgccgtgctacaatcgagatatctcggagtctgagtcctttttctctcactaaatcaaggatgtctctcgctactccctcaatttcagctcgtttatttgcacttttagacactgtgagatgaggggtgttttcctgatatggctgtactggccgctgctcatattggtgttctaaataagcaagatctggtgtataaaggtgccgatgatttctttcaaaaatggtttcagaaatgtcagctccgcactctttagcaagctgatagagctggaaatacgttttacctgtcatacgaaataaatcaagttcatttggctgcctatcatgataggatcgatctactgtgaaagccgcagttatttttgcagcatggagcaagagctgttcaatgacaagaagctgctgcggtgtaaattgataaaaaccatcgatataaatgtgtgctccttttatttcttcagctgatggaatttgctgggcaagaagagtcaaatagtcttctgagtgcacatattcatcttgtaaatgctcctccatctgctgataaagaacatggagatcatgcaatttttcggctgcccgtctttcttctgtatactctgaatgcatgctctccactgaaattttctcaatatcctcaggcagcatacagtatcttttaaattcagccatcgttttttcgatttgctccacaaaccctggcttatcactggcttttttgaatactttaaacttgtctttctgctcttcaatcacttttcttaaaagcatttgaattcctgtgcttgtcacaaattgccggttcgctccaccagtctgctgtaaaatagaccaagcaagacgagtaaaactaaaaactttagctctgatcattccaccggcttcagacgttttcgcaagctcatattccattaaaaatgtcatttgatccgggactaaaaaaatgattggcggacccaacggatcaagccgaagctgttctttgatttcctctaagattgcagtcgtttttccactccccgatctgcctgctaaaaactgaatctccacgttccacaacacctttcttatgtactcatattctagcgaaaataaaggtaaatagctattttccgatcacgttcccattctcctttctgaaaaaaacataggcacctttcctcactcttttcatatcataaaccatcatgaacataaaggaggctggcaatatcatgtattacggttactatgactactcgccttatgacatgcgccaaaacacaagaatcatttcagaccttgagaaggcgatcaatggtgaatattctgcgatccagtgctacgaaaaacttgcccaaaaagcaaaaaatcctgaagcaaaaaagatcattcaagaaatacgtcaggatgaagtcagacactatcaactattttcaaaactatattattctttaacaggtaaaaatcacaaaccaagcgtaacagaaccttgtccagaccaattcagagaagggcttctgtttgcctttaaagatgaacaaaaaacggttgatttttacttaagcgtatcagactatgtccgagatcaaggaacaaaagagctaatgaaacgtatcgctcaagatgagcagcagcacgctgtatggtttttatatcttttaacgcaccatgtatcatagatagtcctattttaataggagagcgtatgttccgtcaaaagatgaaatcgatatttcgttcattcaaactgtcaaagaaagcgttaaatgtagcaaagcctcccatcccttcctcattttcaaacgagaaaatgagaattcgatcataaaaaaaactcctctgccacaaagagcagaaggagtttttatgatcttttaatgaaattttgcttcattgctttgctgctgatgcttgagaatcccatcaattgatagcagcttactgccgctgagagttaaataaagcgccatgacgagaagcgaaagttcaaattcataaccacctacaaatcctctagaaaaaccaacagtgataattgctactgccataattggtacaaataatgctgcgataactcgagttcctagacctaaaatcaaggcgataccaccgaccagctcaattgtcttcacaatataagccataaattcaggtacaccgatttgcccgaagaatgctgctgtacctcccagccctccttgatatgcctgaagcccatgtaaaaagaaaataatccctaaaataacgcgtacaaaaagtgttcctatttcttgatttgttttcatatagtgatttcctcctgtttttacactacacaatgtaatgttaataagtaaaaaaattagtaattaaggttgagcattatcatcaagatcaccatcagaatggctgaagtgacgattggaatcattggtacattaaaaggaatattgtaagttggatttaaaattttttgtattcttaaattcaatgcccgatccccaaaggacaccgcaaactttgtttgtttttgaaactgggttctttttttaaccagtttcaaaagggcctgccctactccaagctcagtgcctgtcttctgaatggcatagtcatctgcaatcacttcacgaaaaacagagtagctttgtctcatatgctttaacactggaatgtaccaaatgacttttgtgagcattgagaacataaaagccttcaaaggatcatagctgtatttgtgatgcaattcatgatgaactacagcgtcaatctcttcttcatccagcatgtccatgagagctgttgataaataaacctttgggtgaagcatccccattgcaaaagcaagcggttcatgacaatgaaatacaatgatatcgttttgatatttctctgacagagattcggttgacggttgttcgactgcgagcatcatatgtcgtttgaattgaatgtactttctgatttgctgtgccatatagaaaatcgcaaaacccaatgtggaaaggactaaggcatccagaaagtattttaaaggagtgaatccatagaattcgagcacagactggcatacatgaatcagattatatgcttgattccagccaaaaaagcttgaaagcacataataccccatctgataaaaaatcgttagaccaatcaatataccgcctaaaaacagcagactcgacttcattttattcattttgctgctcctcttttttagacgctagccttgcttcaagcactttgagcaattcagggtcagcactttcaattgcatccaccatatgattcactgccagcggaccgaaatcgtccatcaatccttgtgtaatccattttgtttgctcatttagaaattcttcttttgttaaaataggattataaatagatgagcgcccttttgtttttttctccacaattcccttttcggttaagcggttcagcacagtcatcactgtgttgaaattaatcggcttctcatctgacagcttttgctgcacctctttaatcggcatatcctcaccatcataaaggatctccataattctcccctctaaaggaccaaaaaagcgattcaatcccttttcattatatttaaaagaaggaattttcatgttatcacctcacactaagtagtgtagtgtaattgaaaatgatagtcaactgataacaaaaataggggaaaatcgttgtatattgactttgtttttggtaaaaattatatctttctttataaaaatgtactaatcatttagtgataagataatcttatgtaaatggtgaaaaaattcgtattttatttatagagacttttgtattatagtgaagttaacaacatttcacttactgaacaaacatataggaagaaggtttacatgtaatgaaacaaggccttcgaaccgatctcattctcattgcgacaagcggtttaggtggatttcttttgtctttaacaggtatgtctattggctggatggtaggtacattaatcaccgcagcttttattgcgatgcgccgccccaccctgtttcagcgtaaaggaaccagcaccttacgtattcacagcagatggctgctccttggtcaattcattctcggaattgaactcggacagaaaatgaatatgaaggtccttcacattttcgctgaaaattggctccctgtgagtttcatgctcgtcttttctattctactggcgatgctctcaggctttgtcttatggaagctgagcaaaaccgatatgctgacaagctttgttggaactgcccccggcggtttatccgctatgccggggattgcccaagaggtgggagccaatacagctgttgtgagtctcgtgcaaacgatacgtgtattaatggttgtactcactatcccctttacagtgttttatttgaatacaaaaaaccaagcggatgcggctgtagttacgcaagggagcgctttttcttcgggcgttttcaccctttcaaacatctcttggaccgctgcgcttattttaggtgcctggctcatgtcacgcctagcagttcgtcttcattttcctgccccttggctgatcggcagtatgctaggcgtcgcagctcttcaagttggtgcgggcgcgctcataggttatgatttgattccttattggccggcacaagcgaacattgcgtctcaagtatttctaggtgcaaccatcggttcaaaaatgaataaacagatgtttgtcgggctaaaaaacactctcattgtggctgtcgtcagctcagctggactaattgctgcaactgtcctcagctctattgccatcgctgagatcacaggtatttctgtcattacagccattcttgctttttcgcctggcggtattgcagagatggcaacaacagcagtcacactgcacgaggattctacctttgttgtggctgtacaagtcgtcagaattattctcgtcattgcaatgctgccaccgtttttccggttcttacatcatgtatgggcaaaaaggcagcctgattataaagccgcaaaataaaaaagagacgctttgcatatgcagagcgcctttttttattcgctggtattccttttgacaccgacaacttgatcctttgaaatggtgccaaaatgccggctgtcgaagctatgtattcggttatctccaaccacaaagtaatgattatttttgattttatcgtctcctgtgatggctttcagctgaaaatcccctgttaggacgttccccattttatgttgtttctgctcttttaaataaggttccttctttttttcaccatcgacaaataactgatcatcttcatacttgatcgtttctcctgggagtccaatgacccgcttgatcaagatttgatttttaggtccgtgaaataatacataatcaaaccggctaattttcgtgagttttggcgagaacttattgattaataattctgttccatctgtaaaagttgggtccatactagccccttctactttgtatgtgacaaacatgaaattctttacttggaacaataagacgatgcctgtaataatcatcaaccatagcaatggcttctttttcattaagagcctcctttgtcctcacgtttactcattcgaatgtttaacctattttctactctctttccaacataccataatactgcaataactagaaccgcaaaaacacttcttaacggattcttaactaaagcagagagatcatacccaataaaactaatgataaaaagcatgacacacttgccagttaaagtagctaatgaaaattgccaaaaactaattcttgataaacctgctacaacattgacggcagcagagggtgtgaaaggaaagcaaagtaaaataaataatggaccaaatccccgcttctccacccaaagcattaatttcttaatggaaggatgcctactaataaagttgagcattctcatccgtccaaattttctgatcagcaaaaagacaagaatagaccctgcacttgcgccaatccaggtcaataaaaagccttcccacaggccgaatgcatttgcattcgctatagcaaacgcaacgagtggtaaaaacggaagaaatgcttctattaaagggagcaatatggcgacaatcggtccaaaggccttgtagctctcaaaaaatgatgtgatattttcgtgagtaaatagggaaagaaatgatgtcaacttgtttgactccttcaaggtttgtctacttttcattttacatggaaaacataaaaatatacaaatgaatccccccccttgagattatttgactcattcgatataataaacaagaacgtgtgttctattaagaaagaaagcaggcttggacatgacgagactatcaagaatacagcttcagatgatggaacaggccatctttcttccaatggtcgtctccatcctcaatcgtgatttgactcacttaaaacaacatcaaacatttaaactaaatgaaccatacattcagctagtgacctccaccttaaaggaagcacagaaagcactttatgaactaaagcagcatttacgtaaagaaaaaatgaaggtacagcaaattgaacacgatgaaggatttacaacgtatctatttatcatggatggctatgaagaaaaacataaatactttaatccacgtatacgtcaccgggtagaggaactgctgactcggtattttcttcatcaagcgaattgaatttgcttcattgtcgcgcttctccattcaaagcaaaaagcctgcctcagcggcaggctcctacatattatgataattcaagctgttctctcagctctgttctcacttcttctaatccagcgccatctaactcaaagtaatacacattcccaggctgataatcatggccctttagctgaatggtatccactgatttcaatgagctcaataacgggaaaaggccgataaactgcttcatggacagattggttgaaacattatcaccaagtgtatcaatgatattgtcataggatgggatcgaagaaatggatttagacttttcaaagatggcttgaagtgcttccatttggcgcttcccgcgcatgaggtcactatctgcctttctcgttcttacaaacgctaatgcttcttcaccgtttaacgtatgtgttcctgtttgcacatgaactttcccttttgagtccttttccatttgttttgcgataccttcatcttcaatcgtgacgtcaattccgtttagctcatctacaatgtcttgaaacgccttaaagttccctgaaatcacatagtctacagggatgttcagcaaattttcgaccgttttgactgacaaatctgcacttccaaacgcatgggcgtgggcgattttatcgtatcctcttcctggtatatcaacataagaatcacgaggaatactaaggagcttaatggttttctctgtccggttcaccgccgccagtaagaccgcatcacttcgtgcttcgtctaccgtttcacctggacggctgtcaattccaagcaagagcaccgagaagctgtcctttcctggatcaaaagcttttacacgcttttgcgaggtgtctcctctttctaatgacacttgcgccttatctgacgcttttgaaattttatagtaggcatatcctgtgacggatactgccatcaccatgacaaaagccatgataaacagcactgctttcacccaaggtctcagccttcttttggatcttgtttttgctctagttttttccttcatcctttccgaaccctcactctatcttagtctatcaatgtaggttccactataacatattttgatgaaagtttcctacacgcaacttatttttatgaacccacaattaaaaacttgtaaaactcagataacccatgcttttctgctagtagtgttctttttaaatgattccgtttcgcattgtctatccatatcatcgcaggtgagaatcagaaaaaaagcaacctctaatgtcggctgctttttcaccattattgaatgttcacttgaaattgtcccttcaattcctcttctgcttcttgaaataactgctttacgctttctgcatactcgccaagagcgtccttgctcatgtcaaaattcacccatgtcagctctactggcagatttacttctcctgtcaaacagtcccatagggcatcaagatttttcccgtagtagtcaggaaggtgtaaaactgtttttagttggtcatgaagctcttcttgcgacctgcacgatgcaccgtccagctgcacttttttcatgtcatcttcccctctcatgcctttattttaaacgaatggaaggaaaaagagaaagcaagactcctcacttttgtttcttgacacttgagatcaaaaggatgagacaagctgccaaaacgaccaagaaaaagacggtcaacaccatctgggttccgtacaaatcagcaaaaagtccgacaaaaacacttggaagacccagacctaaataggcaaataaataaaaccctgcaacggctctagctgcttccttttttccccgctcgacaatcagctgaagaccacctaaataagtaaatccatagcaggctgtacccgcaagcatcgttccggcaagcacaaggatgatggatccgctatttgctccaattagcaagaggccgtatccgcatggaagacaaataaacccggcgaggagcgctgctgtactattcattttgcgaacaaaaggctgcatcaggacacctgccatattaattaaaaatagtgccggccctacccataattcatatccatttaatttaagctgtgctggcaaaaccgaaatcacaaggccgcacaccgaccacgcgacagcaatcgctgcattcgctggcattgttccttttggaaatgttggcatgttcatcatcggtttacctgaatctccttgtacaggcggaacgaaaaagaagacacccacaatcgttaggattaaaaagcccagcacaatccaatagctaagcggcgcaagcgtcatatgctgaaaagaaagaagtgccgtaaaaagagcaccgcccccaaaaccaaccgaactgcataacgcaataaacgttggaatccagtttgacttttctggatataaagcaatcaaataagcggtgcatgtgccaacactcaggccaagccccaccccttgtagcagccgggccaaaaagagcatctgaatggtaggatgtacgatcatcaataaggtagcacataatgaaaaactaagtgcgaccaataaaaccggtttacgtccagcccggtcagatatccccccaagaaaaagcaagactggaatcagtccgaagacatatgcagcaaatacaagggctgtcgccgcttttccgtaccctgcttgttcggcatacaacgtataaaggggcacctgcagatttactgcggttgtaatcataaaaagaccaaataaaacgaatgtaaatggaatgatagataggtgtgtagtgtcttctttagatgcagggatcattttactctctcctttagtcataagcatatgagaacagtgtacacaccttttggcttacttcctatatccaaaaatgacgctattgaccactccatatttccgtgtcatcatcatgttatatgtgacaatgagagaaggtgtccgatgtatatttatttagaccgctcaagtacgaccccgctctggcagcaaatcgtgactgggatcattcaacaaattcattccaaaaaactgaatcctcatgatcagttaacaccgacacgcgtattagcacaggagctcaatgtatcaagatcaacaatacagcttgcttatgatgaactgctggcaagaggttatgtcagcacatctagacgaggcggtacgaaggtcatttcgagtgatcactatgcggcctccgccccccatcaaggtgagcctccttttcctcttccggtaagaccacactttgaagaggcggagaaacaaatgaaccactggctgtcggccaatcaatttcatgaaaagcttgatattgattttcgtcatcaggaaccagccatcgacgaacatttccaaaacatatggaaacgctcgctcatgaaagcattacagcgattagagatgaaagattggggctattcctccccgcatggtttatgggaagtacgttcagaaatacgccaatacttatctgtagaacgaggtattgatgtagaagaggatcaaatcgtgttaacaggaggcacgcagcaagccattgatttgatttcacaggtattacttaaaaaaggcgatacagtagctgttgaagatccaggctttcctggagcaaggctttcatttatgcatcgtgaaatgaacatttatcccgcgcccgtcgatgaagaaggaatgatggtgaatacattaccacaaagaacaaagctgattgcagtgacaccctcccatcagcgtccaaccggtgtatgtatgagtgtgagcagaaggcagcagctgctaaaatttgctgtcagccatcagtcttatatactagaggatgattttgatggagattatcgttatcatggcggaccgcttccttccttattttcagaagcatcaggccatgtgatttatatcttaagcttctccaaagtgctggcacccggcatccgccttgctgccattatcggctccaaagccgtcataaaagaaatcgcttccttgcaatcactcattcaaagacagctgcccattatggaacagatcacactcgcctcttttttcagagaaggagacttcacgagatatgtcaggcgaatgagacagctatataaaaaaagacaggctaccatgatggatgcccttttaacacaacaatttgacaagcactttcatatttatggaacagatacgggtcttcatgtctttttagaaggagcaccagactttgacgaaaaaggcagtattgaggcagcaaaagcagcaggtattggcatttatccattaagtccttattgttttgagagcaatcgaaagggattactgctaggcttcgcctgtacggacgaaaacatgatccaagaaggtgtgcgccgcttaaagcaaatactttatatgtaaaaaagcttggaagtccgccttccaagcttttttacgttgattgctgaatacggccgacttcttcaataaatgcagctgccctctgcaatccatcttgcagatgatgagtagcggaaataaacagcttttcttgatctgggcgctttaatagctgctccacctgacccattcctttttcaaatgaatgaagacctgtctttaactgttcatctgcctcttgataagcggctggaacttcttgatgagcaagccccttttgaatcacatgatcaaaggctttcgtcgcctttttcaattttttatttacttggatctttccctgtccatctgaaataaattggtcggtcatgttctcataagcttcatttaactcatccatataacgctgaacccattgttcatacgcaacttcttttgtgtcttgttttgaaggcgattgacctgcttgctggcaggctgctagtaaggtcactgtcaaagtgaacagcagtatcaattgcgattgttttttcatacagagcctccatttcctattcccattcgttcatatcggttaaaataggaggatcctttaccacatacgaacactttacaagaaatgatttcttttattgtaacagacggctcgtgtcacttctttgatttatgagtaattgcttgaaaatacgtctaaggatccacattcccctgtcatttatttggtggacagtctaccgatacactctttagacgactggatatatggatttggtttcaacaaattcatggtcatggtggatgttttcgtgtcatcatgatgatgcctcatcaaagtcgctttgtcctgttgatttattgaagtttacctttacaagcaatttcaagctcttcgactacttcaccatcttggatgagataggctttttcatggagattgacagcaggacaaatatgatttggaatgatttgcaccttctcaccgatctggacagtctgacggaagccttcgtgataaatgatggcatgctcatcaaatacactggaaacaaatacatcatcatagccttttactttgcctagtccttttgtttgtgtcagcccttttgtacgggtttgagccgtgagccctttggctccaacatctgtaatgacacgagtctttgttggcttactaatgactgtcgtcaggacggctgctgcgcaatatgaaaaagtgccgatcacattggactgagaggcatccatgaaaatgtaagtaccaggtctgatttcggtgactccctttggaatatcaaattgaaataagaacggcggcgttgatcctatgctcaccacctctagcagcatacctgcttcttttgcaatctgtgcaaaccgaagcgttcgattcacagcgtcttcatataatgtctgacaatgcgctttactttccgccttgtatgtgtgaccatcatgagaaaaaatcccttttaaatgaacgaagtcacatgtttttatcgcctgcaagatttgatggaaatcactctcttcaatgacaccagacctctcttctccaacttctatctcaattaaaacctccgcttttttctctgctccacgaaagacctcttcaatttgatgcacatgctctacacaatctattccaaatgaaatgtgtatcgactctgccagctttcgaattcgcttcagctttatctcacctacaatttgattggcgataaagatatctgtcagcccatgcgctgccatcacttccgcttcccctactttcgctacagttaagccagatgcgcccatctcctcctgcaccttcgcaagactaggtgttttatgtgttttcgtatgaggacgcagtttgacctgctgacggtccgcatattgctgcatagccgctagattctccatcatcacctgtttatcaattaatagcgctggtgtatctagttcatcataagtcatcatcatatccccttctctactgctcattatataaaattttatacattatacttaaattatataatttattatacaattatcaatgcttttttctccgagaaagtaagacgatatgctaaacataaggagcccagcggctgaactgccgctggttttagttaatatctgttccgtagctcccttaatataaaatcgtatacaaggttgagctgttgttcctttggatacagcataaattcttgttttttaggaagaccaccatcaaggcgatcttgaaatttcgttcggagatacgctgttctgtgtacctgactctcaaaagatttatatgagacatcgagtttgacggtttgctcatttgtaaagatgaccaccgtgtctccgagggatgattcctggaaggtatgaatgtatttgtgggagatccagccgcactgaggacggttggatgaataggttgggaagaaatacagatgattggatgagtcaattacaatgggaggcttatgagatattcctgttacttcatatgttcccgcttttctgcctgcatagcttgagccaaagaatctgcagctgcgttcaataatttgcaggggctttaattcaacgtaaaagcttgtctctctttctatgacttttgaatatactctttttccttcttcaactggaaggaccgccattgttgtttgattaatgacgtatgaatctaaaggtgtttcactaattcctgacacttcatttcctcctgtgttaatttttggttattttagatactattaatctatcaccaacatataagaaacgacaggattttttcaaaatttattaaaaatcatttttttatcgtattatttagttcatttgatctatcgaaaagccttttttaaagttatatcacatcgtgtcgatcggacaagaggtgtcgattccgctcaaaaataaattgtctaaaaattataaattcttgttgattttttctccaccaatccatatactataaaaaaggcatcggggggattctttatgaaagagaaaaaaacgtatgctgagctcatgaagtcccgcaacacccaaaaaaccgaagaaaacggcgtgacgattttagacatctatattcaaatggttttagatgaggcgctttataaacagcgcttaaccttccttagagaagagattgataaggcactggatcagcgtgatgaaaagcgattcaacgacctgtcagctcaatatgcagaacactgcctacactaatcatgatgattttacttgcggcaaagagacagcaactcgtctctttaccgcaagttttttgtttatccatttaaaatggttcctccatttacatgcagaatttgtccatttatataagaggagtcttcgctcgctaaaaataaatagctcggcgcaagctctactggctcacctggccgctccattggaacatctccgccaaattcggagacttccttttccgtaaaggtcgatggaatgagtggtgtccaaatgggccctggggctaccccatttactctgattccctgtttaataagcgataaagataatgatctcgtaaatgtcacaactgccccttttgtagctgaatagtcgatcaaggtttcatgccctttataggctgtgacagatgcggtatttatgatactgcttcctttctttaaatgaggaagtaccgcttttgttaaataaaacatggcaaaaatattcgtttgaaatgttcgaagaagctgatgcgaggtaatctgttcaatgcttttttgcggatgctgttccccggcattgttcaccaaaatatcaatggaaccgaaagcatccttcgtttttttgacgacctcatttgaaaacgcctcatctcctaaatcacctgcaattaaaatagcgcggcctcccgccttttcaatatagtccttcgtttcctctgcatcgcggtgctcactcaagtaaacaatggcgacattggcgccttccttcgcaaataaaaccgagactgctcttccaatcccgctgtccccacctgtcactatggctgttttccctgctaattttttattcggcacctctcgatcaaaaacaggtcttggattcattttatattcaagacctggacgctcactttgatgctgaggcggcaatgttttcttcggctgctttgttgacacgtctgtccactccttccttttatcttgtttatttttatgtgttggctatttttttatgtatgtcgaactagtttcctttcgaatgtatgtttttcttcatcgaggaaaaattatacacaacaagtgactaactggaggcgataatatggaacaagaacataaggggttggaacaggcaaaatcgttatggattgcggatagtcaaaagcattcttttcctgcagtacatgaggatctcacagcagatgtcatcattgtcggcggcggtattaccggtatcgctaccgcgtttgaaatgacagaacgcgggctggatgtcatcatcattgatgctgatcaactgctgcaaggtacgaccggacatacgacagctaagattacctcacagcacgatgtatactaccatgagctgatccagcaaattggaatgcccaaagcccgtttgtatgtagaagcaaatgagaaagcaaaagagctgattcaagcacgcgttcaaaagtacgacattgattgtcagctagaagtcaaggatgcatacctctatacaaaggaagaaaacggtgtcaaaaaattaaaaaaggaattagatgcctacaaacagcttgggattgatcgggaatggaaaacagcgcttccttttgatgctgacatcaaggctgccctagcaatgacgcagcaggcacagttccatccccttcattatctcaatgcgctcattgaccagctcctagagcgaggtgtacgtatttatgaacagacaactgctgttgacgtgaacgaaggaaaccgccctgctgtcgtcaccaaaaacggccatcatctgactgggcgctatatcatttcctgttcgcactttcctttttatgatggaaagggactttatttcacgcgcattcacccagagcaatcctatgtggtagcagccaaaacaacgaagccgctcccagatggaatgtacttagggatcgaccagcctgctcattctttaagaacagcagaatgggagggtgaggaagtggtgctcatcggaggagaaggtcataaaactggacaaggcggggatgaatctgctcactatgaaggattagaaagttttggagacgccacccttggaattgaagaggtgctgtatcgctggtcgacacacgatatggtgacaatggatcaaatcccttacatcggccgcctgaccaaacaccatcaaaatatctttgttgcgaccggttttagaaaatggggcatgacaacaagccatgtcgcagctactcttatcggggatttgattgaaggaaaatcaaatccatccgaatccatttttacgccatcaaggcctgtttctgattctttcgtcaaagatttcgttaaagaaaacagcaatgtcgcagccaagctgatcagtggtaaattaaaacgaaccgatcaaaccattgatgatttaaagccaggtgaaggcggcattgtctcttatgaacataaaaaatgcggtgcctttaaatcagaggacgggaacatttttcttgtcgatacaacgtgtactcacctaggctgtgaagtcgcttggaataatagcgatcgcacgtgggattgcccgtgtcacggctctcgtttttctattactggagaagtagtagaaggcccagcaaagaaaccactaaaaaggtcatataaagaacagtaaaattttactgattccctttaaaaaatccaatattatccgatagataatataaagtctgataatttgtgatgattatagggggacaaaaacattgttatttaaaaaagagaagaaaagaaaaaacactgcttttttcacacagcaggacgatggaataaaacgtatcaacttttctgacaatacggatatcgcaaaacaaatcaagatgatagatctgacgcagcatgacctattgattctaaaacagctcaatccaattgttcaggacgatatcgcacatatcgttgataaattttataaaaatttagaagttgagtcttccttgatgcatatcattcaggataatagttctgtcgagcgtctgaaaaaaacactccgcattcatattagtgaaatgtttgcaggtgtggttgatgaagcctatgtggcaaaacgaattaaaattgcgcaagttcatttacggattggccttcagcctaagtggtatatggcagcattccaggatcttctgctatcgattatggatttatttgctcagcatatccaagatttcaaagaatatcagacagcagtgaaagcgacgacgaaaattttaaatttagaacagcagcttgtccttgatacgttccaaaatgaatattctaaaattcgtgatgaagcagaacagcagcagcaggagctccatacaaagatcacagaaacatcaaattcacttgcttctctcttctctaacacaacaaatgcagtggacaagcttgtatcaaaatctgatgagatggcagacatgtcacaagctggaacgcaaatttcagcacaggttgaggaaaaatcgatcggcggtaaaaaagaattagaaattcaacaaacacaaatgaaccaaattgatggcagcatgacaaagattgaaacagaaattaagcgtttagaagaaatcgcaaaacagattgaacaaatctttgggattgtcacaggcattgcagagcagacgaacttgttatctttaaatgcctccatcgaatctgcacgagcaggcgaacacggaaaaggctttgctgtcgtcgcaaacgaggttcgtaaattatcagaagacacaaagaaaacggtgtcaaccgtatctgaacttgtcaacaataccaattcacaaatctccattgtgtctcagcacatcggagacgtgaatttactcgtgacagatagtaaagaaaaaatgactcaaatcaattcgctcttcgatgatatcgtcagcagcatgaacttaagcaaaaatcaaaatggaaaaattgaaatagatcttcaaaccttcctaaacgaactgaaggaagtcaaacaaacggtgtctcaagttgccagctcagtcgaatccttaacaagtctcacaaatcgctaatccagtcttttttcttctgctttagtataatagaagaaaagatagaaaaggcgggatttgattgacaacaatttgcctagtcagacacggggaaacagattggaatgcagcgaaacgaattcaaggacgaacagatatccctttaaatgatactggtaaatggcaggctgaacaaacgggcctttatttaaaagatgcccattgggatgttgtcatttccagtccacttacaagggcaaaagaaacagcacatttgattttaaaacatgtagatgcgcctcttgtcatcatggatgatttcattgaacgtgattatggcgatgctgaaggcatgtcatttgaggagcgccaaaagctgtttccaaataaacagtatccaaatatggagccgcttgagacaatccaagatcgaatggtagaaggcattgagaaagtcagagcagcctatccgaatcaacaagtcctaatcgtggcacacggcgctgccatccatgctttactcaccaccttagcggatgaacatcttggtcttgagaacacgagactcgtcaatgcttgcttaaattatgtggaatggaaagatggtaaatggaaggtgcttgattacaatgtggtcagccatttaactcaatcctctcctacttaaagaacctgttatgtaaacaggttctttttaaatgacaaaaacaatgataaaataatatttttttatatcgaaattcgaaatagatgctagacgtttctacctattttaaggcttttcgtgtatcgaatatttctccagaaatggatcataagaaaaaaagcacacttcctttttaatagataaccgctgaaatagtagaataaacatattttaccatcatttccaagtgacttaattccccaattttcgctaggactttcacaaaaattcaggtctactcttatttgcctacttccattaaactgaatatacagaatagtcaaacggatcattcttatagactacggatgattattctgaaataaaaaaaagggatgtggattgtgcgtgaaaaagaaaaatgtgatgacaagtgttttattggctgtccctcttttgttttcagcagggtttggaggctccatggcaaatgccgagacggtctcaaagtcagatagtgaaaagagctatattgttggctttaaagcctccgccaccacaaacagctctaagaaacaagccgtcactcaaaatggtggaaaactagaaaagcaatatcgtctcattaatgccgcacaagtaaaaatgtccgaacaagccgcgaaaaaacttgaacatgaccctagcattgcttacgtagaagaagaccacaaagcagaagcatatgcacaaaccgtcccttatggaatccctcaaatcaaagctcccgctgtacacgctcaaggttataaaggtgctaatgtcaaagtagctgtccttgatacgggcatccacgctgcacaccctgacttaaatgttgcaggcggtgccagcttcgtcccttcagaaccaaatgccacccaagactttcaatcacatggaactcacgtagccggaacgatcgctgcccttgataacacaattggtgttcttggggtcgctccaagtgcttccctatatgctgttaaagtattagaccgctatggcgacggacaatatagctggatcattagcggtattgaatgggcagtagccaataatatggatgtcatcaacatgagcttaggcggaccaaacggttcaacagcgcttaaaaatgccgttgatacagcgaataatcgcggagtcgttgttgtggcggctgcaggtaactcaggttccactggttctacaagtacagttggctatccagcaaaatatgattctaccattgccgttgccaatgtaaacagcagcaatgtcagaaatacgtcttccagcgcaggtcctgaattagatgtttctgcacctggtacttctattttaagtactgtaccaagcagtggatacacttcctatactggaacgtctatggcgtctcctcatgtagcaggagcagcagcgcttatcctttctaagtacccgaacctatcaacttctcaggttcgtcagcgcttagaaaacacagcaacaccgcttggtaactccttctattacggaaaagggttaatcaacgttcaagcggcttctaactaaaaaagaataaataaaatccggctgatgcagccggattttatttattgcttcctcgatgtttcctctttttccgctgctttttccatctccataattctctccatcatcgttgggtgcccgtagcggaagaccttcactaaaagtggtggattcacctgagacagtcctgattttgcaagcttttgaaaagacgtcacccctgcctctccgtctttagtcaggtttatcgcatactcatctgctgcacgttcttgatgtcttgaaactgcatttgtaaaaggtgatgctgcaaatgacagcatcgatacaatcatgagaagaagcggaagagcggcgatatcgcgcggctccctcagccgaaatagaactgctcctttgcgatagaaataaaaatagagacggtcgattgcaaaaaatcccgcaagcgacagtactaaatatcctgctaatcctatatagacatgcttcatgacgtaatgtcccatttcatgcgccataataaataaaatttcgcgatctttcagcttttgcagtgtcgtatcccataacacaatacgcttattttcaccaatccctgtgacataagcattcatcgtgttcgttttctgtgacatattgacctcatatacatgatctgccgggatatgagctttgtctgcaagcgttaagatcttgttctcaagagcttgatcctttagtggataaaaactgttatataacggatcaataacgactggctgtataaagaagagaaatagtgtgaatgggactgtcagacaccaagcatacagccaccagcgctttcttcttttttgaataagccaaaagaatataattgcacatagggcaagaagcggatattgaatccagaaatctagaatttgatctttcaaccagcttgccgtactttgagcagatactccgtagtgcaaagacagctgatagccgatccacttaatgggaagcgcaatcagcattgtcaacagcgacaatacaaacacatatacaagtttgcttaaaaatgtaaaacgagctgctgccagactccagtctgctaattttcgtgaaaaccctgaaatgagcagaagaaaaaagacataccaatctaatggaattgtcatgaaaaacagcaagttacgtatgttcgagaaattctcgctgatgacaagctcatggcttgtcataaatgtttgcggatctgcacttgttccttttacactgtcaggaaccgatgcatccccaaatagaaacaaataagaataaataaaaagaccgtacaatatgtatgctaccgttgcaagagctacccatttacgtcctcgcacaggtcagcctcctttccatcactttctctattctaagcatccattcttttgtttagaacctgtctcatgtggctccatcatagcatgccctatctgaaaaagctttcacgaaaaaaatgattatgctactcaaaaatcggagatgctacatataaaatagtgagttggaggatcgaaatgaagaaaatccttgcaggagttatgatctttggacttttacttattaccttcttttatgtattcagccggacgagcgacatctttgatgagaatcgagctgaaaaattgctcctttcatctgaaaacgagtccatttcttatgaaatagatgataaggacacagcagaagatttaatagaagaattaaacaaaggcaaacaaacaagcaatcatctcaaaaaaaatttaaagaaaccagattatatcgccaaggtgatgtacggccgaacaaacggcaccacctttcagctttggacaaaccgttcgcaggttgtttttttagtagatgggacttattatgagctgaatcaaaaacagtctcattcttttcagaaacagttaaaagaagccattcaaaagagctgaaattttatctctttgtcttctgaacagtgttatagaacctgtacacactaagggagtctcttcataagagagactccctttttttatttactttcctctgcttgatacttttcctttagtgctcttcttaaaattttacctgttgtgttctttggaatatcatctatgaaatggatcgtttggggctgcttatatttcgctaaaaagcgtgaacaatgtgtgatgatgtcttcttgatcgatgtgagcatgtttcttaggggaaatgtaacagacgacagcctctccggtgttcggatccggcacaccgatgacaacggcttctgctacagcttcatgttgataaagcacttcttctacttctcttggatacacattataaccgccaacgagaatcatatcctttttccgatcgacaatataaatgtatccttcttcatctcttcttgctaaatcaccggtgtacagccacccgtctctaagtgcagcttcagtatcttctggcatttgataatagcctttcataatgttgggtccttttgctatgagctctccgacttcatttggaccgacttcttctcctagttcattcacaatcttattcttcacattcataatgtcggtcccgactgaaccgggttttctctttccatcaagagggttgaatgcagtgactggggaagcttctgataatccgtaaccctccagcaccgtgacaccaaattttttctcaaaaccgtaaagtaaagcaataggcattgaggcaccgcctgatatacaaattctcacagaggacatcgctttttcatgcccttcctggcggtataaatagttatacatagtcggaacaccaacaaataacgtgggcttctctttttccatcattcgcaaaagctctgatgggctgaaatgcggcaggacatagatggtcgcgccatgaatcaatggcgcattcatacaaaccgttaaacaaaatacgtggaacatcggcaatgcggcaatcaccttgtccttttcatcaatggataggtactcagcaacgtctctagcatttgaatacaggttgaaatgagtcagcatcgcaccctttggttttcctgtcgtgccagatgtaaataaaataactgccgtatcatcctgatgaatagaaggatgcacggtctctttcgcatggccagacacaagctttccaaagaagacaagttgatctgatacttccttaaaacttgatctgcacgcagattcattttctgcacaaataatcacccgttcaatagacggaagctgttcgtacacctgctcgtacactggcagtagctgttcaggtgcaacaatgccttttacatcacctgtaatcagcatatagccaatttcactaggcgtgtatgttggattgattggtactacgacaagccctgcctttaaagcaccaaaaaaagaaatgacaaaatgcggtgaatttcctaaaataagcgcgatatgatccccggcttgaaacccttcgctcactaaaccatctgcaaagcgctcgatacttgtcatgagctctcggtaggtccactgatttccttcaaagatcagtgcgatatcttctcctttcgtcatcgccgtctgctctagatttttgatcaaatccattctcccaccccttacatgtcatcaatgaatgaataaccattcattttatggccaaacattcctcctttctattataatagacaattgaaaaaatccacaagatcaaatgtaaatcgctttcatttctttcaatcaaaaaagcaccgctatctctagctgtgcttgtccctcttaataaatcaaatcaagaaaatcctcttttgatacgttgccgaagtagtggcgcatgtccatatcctctaatacgtcgctgatcgttttgcgatcatactgctgcccaatgagtcttttttcaatatcagcaatatcccctacaccaaagaaatcaccaaagatcttgcaatcctggatcattccttttttcacttctaatcgaaggtcaatggagcctgctgagaatctcttagaatgctgcaaattaaatttcggcgaacggccgtagttccattcccatttttgatatcgatcaagagaaatctcgtgaatcttttcccaatccttctcagtcaactgatattgagggacatccccattcgtgtcgaaaatgtagcttaacagaatttttctaaattcttctgttgtcatcttttgatccattagttcactaatattggcaaccctgcttctaatggatttaatgccttttgattcaatcttttcttttttcacatttaaagccgaaacaacatgttcaatttctgaatcaaataggagcgtgccatggctgaaaatgcgccctcttgtagcaaactgagcatttccagaaattttccgaccatctgccatgatgtcatttctgccacttaattcagctttgacgcctagcttttcaagcgcctggatgactggctccgtaaactttttaaaattatggaagctgtccccatcgtcttttgtgataaagctgaagtttaagtttcctttgtcatggtaaactgcgccaccaccggacaggcggcggacaactttgatgccgttgtcttcgacatactttgtgttgatttcttctattgtattttggttctttccaatgataatcgacggctggttaatatagaacagcaagtacgtttcttctgggtctaaatattttaagcaatattcttcaattgccaaattaatcattggatcataatgttgttcgttatcgataaacagcatctctctatcttccttccttgttccatctaagccctgaatgggcaagctgtatattgccagtatataacgcctgtgcttcattgactaggtctttatgacggccaaaatggggcaggtgggtgataatcagttccccaacatttgcttccattgcaagcttgcccacctctgtactattcatatgtcctgcacccgatccgtcctgtccagcgtagaagttgctttcagcaattagtagatctgcatccttgctaaatgggacaaatgcctcctgataacttgagtctgctgtatacaccaccacagcatcctctttctgaattctcatcgcatagcattctgccggatgaaccgttttcaaaaaatcaatttgaaatggaccaatttgaataccctcttctggctgataagcctttgccttagtatgtacgtcatccgcaagccgcccaaatgcttcttgattacctgtatgtccatagatcggaagcggaccgctgctttttcctaaatgatatcccactagcttcgcatattggagtggtccgatatctgcaatatgatcgtggtgataatgagaaaggagaacagcatcaagttcttctatatctatgtattgctgcagtttggaaagaacaccgctcccgcagtctacaagtagacgaaagccatctgattcaaaaagataccccgacgtcgcttcaccagcggccggaaaccctccatagcatccaatgacagttaacttcatcgacatttttccctccttttctaaaaatccccttcttacaatatacccatttttcatgaaaaaagcattcttcttgcctattgttacaaaacagattgacaattaataatctgttataatacaataatagcaacaaaacgtattggaggatgacaaatgctaggaaaaatcacagagttttttagaaatttgccctcaaaaaaatgcacaaaatgtggaaatgatttaatggaacaacacgagtgttacggtaatgaatgtgaggaatgctcacaagtaagttatcttaaataaggtaaaaaattgaattaaaaagcacttttttcctccgtcgtcagttggagtcaaaagtgctttttattttttctgaaaaataggtaaaaaggtaaaacccttgttataaaagggttttttagtattttcatctgatgagttttagttccgaaggcactttttattgacttgaatcaataatggaggttctaaatgttcattttttcaaacaattttgtattttcttaatataatttaatcgtggacgaaactctttaattttagttatactttaattcatatattaaaacttaatatgatgggaatattcctttaatgaatatgttagggaggaaatctatgaaaaaattaaaatttggattagctacacaaatcctaatcggtcttattctcggtgtcgttgttggggcaatctttttcggtaacccaggcgttgagacttatttaaaaccaattggagacttcttcttaagactcattaagatgattgttataccaattgtcgtatctagcttaattttaggtgttgcaggtgcaggtgatggtaaaaaggtagggaaacttggctttagaaccattctttattttgaaattatcacaacatttgcgattattcttggtcttgtgcttgcaaactttgttcaacctggtgcaggcgttgactttggaaatacggaaaaacaagatattagccagtatgttgaaacggaaaaagagcaaagcagcaaatcaattgctgatacgttccttcatatcgttccaacgaacttcttccaatcattggcggaaggtgatttgcttgcgattattttcttcactgtgctatttgctcttggcgtttcagccatcggtgaacgcggcaaaccagtgctcgccttctttgaaggtgtatcacacgccatgttccatgtcgtcaatgttgtgatgaaagctgcaccatttggtgtcttcgcactcattggtgtgactgtatcaaaatttggtcttgaatctcttatttcattaggtaagcttgtaggtcttgtttattttgcgctcgctctcttccttatcgttgtattcggaattattggaaagatgattggcgtcaatattttcagatttcttgcctacatgaaagacgaaatgcttcttgcctttagtacatccagctctgaaacagttttaccaagagtcatggataaaatggagcgcattggatgtccaaagggaattgtttctttcgttatcccaatcggttatacatttaacctggacggctccgtcttgtatcaagcgatcgctgcgcttttccttgcacaggtatacggcattgatcttacgattgtccagcagctcacacttattcttgtactgatggtaacatctaaaggtatggctgccgttcctggtacgtccttcgttgtattacttgccacattaggaacaatcggtgtgcctgccgaaggtctagcatttattgcaggtgtagatcgtatcatggatatggcacgaacagttgttaacttaacaggaaatgcacttgcagctgttgtgatgtctaaatgggaagggcaatatgaccctgaaaaaggacatcgcgtgatgactggacaagatgtacctgaaccgacacagctttcaagctaatgaaaaagaaccccgatcaatggggttctttttttatgctgtgattaatgacgattgcacgtagtgataaagaagattcgctgtatggacaagggaatcttcatgcgttcgttcaaaagcatgcgaggaatctattcccggaccaatcagtccatgaatgatatcatgccctgctcgaatcgctgctgatgcatcagagccgtaataagggtaaatatctagacgataatcaatattattctcttctgctaatgcggctaaatgcttgcgtaatccataatgataaggaccacttgagtccttcacacaaatagacacgctgtattcatctgttgattgaccatcgccgatcgctcccatatcaacagcgaggtattccaccgtttcttctggaatattggagtttccaccgtagccaatttcttcattattagaaattaagaagtgcgtcgtatgcggcaatgtgatgttttccttttgaatgcggaggatgagtcgcagcaaaagcgctacactcgccttgtcatcaaggtgtcttgatttaataaaacctgatgacgtcacttccactctagggtcaaatgagataaagtcccctacttgaatgccaagtgctttgacatcgtctgcattttgcaccttttcatcgagacgaatctccatattctcttggtttcgttttgcttttccagcatccgcatagacgtgaacggatgtttgatgcatcagaatggtacctgtgtatgtatgacctgctgctgtttcaatttcacaatattcgccttcaattgagttatattgaaagcctccaatgagtgcaagacgaagccgtccatttgatttaatttcctttaccatcgcaccgagcgtatcgacatgtgctgtcagcatgcggtgttccttgtcatcagttcctttaatagtggcaattaagccgcccttacgatttcgttttgtctcaatatttacatcttgtaaaaagcgttcaacaaagccgatcaccttttctgtattccctgacggacttggaatcgatacgagcttttgaatcagctgaacggtttcatttacttcagttgtcattcggcatttcctcctttgtgtgaaagcaattccttccatgtatgccttttatagcatctcttcttaaaatatatcgcttcgggttcaagatgtctaatttcaaatcaaaaatcctttctccatcaagagaaaggattcattgattaagcttcgtcttgtttcatttttcttacgttccaagcaaagtatgcggttgttgccgccatcatgatgatcgcaactgtaccgagaatcgctgcttggtgccataaatagctgtcatcaccgcttgcaatgatcgttctaaatccattgattgtatacgtcattggaagcagactatgaataacttggaagaacttcggtacaagctcaagcgggaatgtaccagcacttgctgcgagctgaagaactaagattatgacggcaatgaagcgtcctgggttccccattgttgtggctagcagctgaataatcgctaagaatgtcagactgacgacgattgcaaatagatagaagcgccagagactttccacctcaagaccaagtccaaagatgagcatcgtacttgcaatgactgcttgaaggataccgacaagcagaagcacgctatatttgctgacaaaccattcaaacgcatttctagggcgtccagcagggtctttcattgggaatacgacggtgagcattagagccccaacaaagagtcccatggataaaatataaggcgtgagccctgttccataattatcaatctttttcgctgtatcgttttctgttttaacagggcttgcaatcatattgtaattatcttgatttgcatcaatttcacctgtttcatcagcagcgcttttcaatttattggacagcttacctgtaccgctttttaaatctcccaatcctttatcaagcgattttgagccttcggcaagcttagatgtattgctttggatatttgttgaaccactttccagcttatttaacgcagcgctaagctggcttgatccatttgcaagcttatccgctccgcttttcgccgtatcaagctttccatttgctgtttgcaggccatcttgtaattggccttgacctgtttgaagcttcagtgcaccttgatataatttattcgtaccagatgtcatttggtcgatcgcattttgaatcgcgactgtagacgtgtacagctgttctgttttctctggcagctgtttgacttgctgcagctgcgcttttgcagatgcaactgcttgttgaacctcacttgcatcaggcagttcctgcaagtccgctaagctttgttcgagtccagacagatcaggcagttcgattttaggcaggctgttcagctgatccattgccgcctttttctcttcatctgtcatagagctgttttggataatgctttttactttagcatctcgatttgataatgcttcttttaatgaagcaagttttgtactgaacgtttttgcgtcttttttcacctgatcgagtttaggcgccatcttttcaagattcgctaattctggtgacgataagactttttctactgctgcaattttttctgaaaaggattgtgctttgttgtttagctgctctatgcctgctgtgaattgcggcattttagaagcgagctgctgatgtccttctcggcttgtgtttaatccttcggttaatgtatcaattcctgaaccaagctctccaaatttctgatcaatggtttgatagcctgttaaaagctgaccaagtccactgtctaaagactgtatgcctgtgttcagttcacccattttccctgcgaactgatgaacaccttcgctataggttaacgtaccttcagccaatttggctaagttgtcttttaatttcgtactgccatcttttgcgctttttgttccgtcatcaattttcttcgcgccatcgcttgcttgatctaatccttttgcaatcgttttgaaattatcaaagatgacctcggcgtaattttttgtgacttcttttgaaaccgaatcttttaatttgataatggcattattcgcaatttgtgacgctgcatagttggcgcccggattcgtataatatttcagattcgattttttcggatgcttttctagcactgtacttgcatttttcgagaaattctttggtatttccaccacgaggtaatagtcctcgttatttaatccttttatggccttttcatgactatcgacaaagttccatttaaaattatcgtttttctttaattcctttactaaatcatcgccgacttgaagggttttcccgtcataatgactgccctcatccaagttgacaaccgccacaggcaattgatcaactgtaccataagggtcccagtacgcttttaaaaatacaccactgtaaatcagcggaataaataagacagctaaaatcgggatcagtagttttttgctggttacaatgtctttccattgattccgaattaaattcattgctgttttcctcccatagatgaatgactaaatatacaatttggtcatttgaactcaaaaaaaattatgttgttgcagatagtccttttaagacataaagctccagcgattcagctacctcttcttttgttaaaggctcgtatcgcttttcccaatcaaaaatcaatgcaatatatagtttcaccatcacaaatgcagtcaattcaggatcacaaggcttaatgtcgcctttatccatcgcttcttgtactttcattttgatatagcgaatgatcatctgctccattttttcgatcatttccttgaccgctgacgtgccaagctccgcattttcctgaaaaatcttaattgtgagctggtggttttttcgaaattctaaaattgcaaagagtgctaagtgaaggttttcagagaaactattcttctcatcaattgcctcatccgcaattttcctcatctctagtaaaagggatgtgaaaatttcatcaaacaactcttctttgtttttgaaaaatgtataaatggttccttttccgacgttggcaagctttgccacaagatccattgttgtcgctttatacccgaattgagtaaatgccttcgtcgcaccatctaaaatcatttgtctcctatcaacactcatgatctcactcctgaaatgactatttgaatgttttggtcattaagtacagaaagtaatataccatatccttttcattagatgcaacaactttgttcacatttatgattcccaactctttttgaatgatccaaacacaaacaactccctttccatgacagaaaagggagttgttttttatgaaaatagatacgatacagcctctgagatggcggcttttccttgatcaatacaatcagggattccgacaccttcaaaagcagcacctgtgatataaacaccaggatatgattgcttaaacgtttctctcatgttcgaaatagctttctgatgaccgacgtgatattgcggcatacttgtcttccagcgagtcactgtcgtcaattctggatctgctttaatatccatgattttctttaaatcttcgagcacgatgctgacgatttgactgtctgactgctcgacaatcgattcgtcaccagcttttccgacatacgcacgcaatagcgtttttcctttcggagcggtatgcggccattttttgtttgtccatgtacaggccgtaatagagaaatcactgtttcttgagatgacaaaaccagtgccgtcatattcattatgaacatcctcttctttaaaaccgagtgctaccgttgcaacagatgtagaggtcatgtcatgcaaatactctagccctgcttctttaggaaacatagaataaatcgattgatgcggagtcgtgacaatggctgaatcggcaaaaagcgtttgaccgctgtctaattgcaaaccatagcctccatccgttttttcaatctgttttacttttgtccctttatagaccgttgtcagcttgagcttactttctactgcttccacaagcgactgcaatccttgattgatcgtttggaactgtccttgtttttttgcagtcacttgctgggctttcgcatgctgctgtgattttttcatcccaagaatcaaactgcgatgctgctgttctgtttgataaaattgcgggaatgtggacattaagctcaggcggtcaatatcccctgcataaatgcctgatagaagcggctcaattaaattctcaacaacctcatcacccacacgtcttctaaaaaattcaccaagcgactgatcttcggtctgcttgctttttggcaacacgaaatccatcgccgctcttgcttttcccgcaactgaaaaaagaccagttgtaataaatgggctgatttgagttggaatccccataacagcaccctttggcatcgggtgaagcttttcattgactagtacatacgcttgcccagtttcattattgacaagctgatcggacagaccgacatctttcgcaagctgcggcccactgacctttctttctaaaaatgaatcaggtccacgctcaatgatgtagccgtctttatataatgtttgtatttttccacctagcctagggctcgcttcaataagtgatatttgaatcggaagacctttttcttcgacttccttttccaaatagaaggcggcggctaaaccagtgatgccaccgccaatgatgacaaggtgtttttgattgtcatgcataggatcgccttcttttatatgattacttgctttcgtcaagcttctttaatacgactgttgccagagcatcaataaatgctggtttcgcatttggcatttctggacgatagtaggctgcaccaatttcatctgtcacgactttacattcataatcgttgtcgtataacacttcaagatgatcagcgacaaaaccaacaggcacatacacgaatgtttgatagcctttttgttcaaataaatctcgcgttaaatcttgcacgtctggtccaagccatggatccggcgtattgccttcactttgccagccaatttcatagtgttcaattcccgcaccttctgcaatcattttagcagattgtgcgagctgatccggatatggatctcctgctgcaataattttttcaggaaggctgtgtgcagacacaataagtactgcggaatctctttcctcttgactcattgatgcatacgtatccttcacttgcttcacccaatagtccacaaacttcggctcatcgtaccagctttcaacagacgtaatctgtagattgcctagcttgtccgcctcatcttgtgcacgtttgttatatgatttcacactaaaggtagagaaatgcggcgctaaaacgatactcacagcttctgtaatgccgtccttgtgcatatcagcaactgcatcctcgatgaaaggctcgatatgttttaagccaatgtacacatgaaattcaatgtcgtcttgaatgtcattcaagtgctcacacaaaccatgtgcctgctgctctgtaatttttgataaaggagaaataccgccgattgccttgtagcgatcctttaaatcttgcagcatctccggctccggctttctgcctctacgaatatgtgtataataacgctcaatgtcttcttctttatatggggtgccatatgccatgacaagaagccccattttctttttctccacaaccaacactccttcagatcaattgaaatagtttagatggatgattttttatgtttagctgaatagtcgtgaataaaatcggtcaacttctttaacgtatctggtgaaacatctggaaataccccatgacctaagttaaagatgaagtgatctgatttcatcccttgatctaagatgtcttttgctctttcttcaatgacttcccaaggagaaagtaaaatcgttggatcaagatttccttgtaacgtttttgtgagcccttcttttcgcgcttcgtctacactcatacgccaatcaagtccaacgacatctagcggcaggtcatgccaatctttcacgagatggcttgcaccaactccgtacatgatcattggtacattttcactcttcaactctgtgaaaattcgctgcatgacaggtttaatgaatgtccggtagtccgctgcatttaaagcgcccacccatgagtcgaagatttgaaacgcactgacccctgcttttacctgcgcgcgtatgtacgtgatcgtcatatcagctaatttgttcatgagcagcatccatgtctccggctcactgtacatgagcgcttttgttttatgatagtttttagatggaccgccttcaatcatatagctagccatcgtaaatggtgcaccagcaaaaccgatgagcggtacattcagctgctccttcgttaaaagctgaatggtgtcaagcacatatggcaggtcttcttcaggatgaagttccccaagacgttcgatatctgcttttgtccgaatcggtgaatcaatgacaggtccaatgccatttttaatttcaacatccactccaatagctggaagcggggtcataatatctttatataaaatcgcggcatctacaccatattgttctacaggaagtcgtgttacataagcacatagctctggctgatgcgtaatttcaaatagcccgtacttttctttaagggcacgatattcaggctgtgagcgtcctgcctgtctcatataccaaactggtacatggtctgttttttcccctttgcacgcctttaagaacgtgtcattaaaagccttcgtttttcccattacctttcattccacctttcgccttacactctctttgtataaggctcaaacactgcttttactataccgctttttcaaggcacggtatactaaaccggctcattgttcaaaaaatcgccgaatattaacgtccaaaagcctctggcttgacatatggactgccttctccttcttcttgcgtttgggtattatatggaaccaccttatacgccgcatctgaaaacacattggcatacggcattgtatagctatttgtgcctgtcactgagtcaattagcgtctcgtttccattcctcttttcataaatacggtattcaactcgtttatcctcctgcttgtcccaagacagctctaatgtaaacaatcctttgattttaaacgcatagcgggcttcaaatcctgatagtccttctaaatgaattggcgcttgaagttctttaatcccctctggttttttaaacgtttcattcgtcattcgggccgccgttaaaatatccttaaacagctgcactgggtattgacttccgccagttaagtagtgactgttatcggttttgtcataccccatccagatcgcacccgttgtactcggcgtatagccggcaaaccaagcatcttttgttgcacccttcacacctgaatatgtggttgtgccagttttaccagctaaatctccagcatatgaaccgctttgggctgttccgcctttgacgacttgctgcaacattcttgtcatattccaagcattctgcacgctaaacactcgttctggcttactgctatttttctttaccgtttctccttcatcattggtgattttctgaatgaagaaaggctttttatatacaccttcgtttgcaaatgtatggaaagctcccgcgatttgaagtggagaaacccctttttctaaaccgccaagggctatcgcaagtccttgatccgaaatatcgattcccattttctcgagatatgttttcgaagtatcaataccaagctggcttaatgtccacaccgctgctgtattcttacttttcatgagggcctccaccatcgtgaccttgccttcatactgcccatcgtaattctttggagaatagccgtcatagcttttttcttcgtcttcaagcagggaataaggtcggaattttttctcctgcagcgcaggcccatataccgcgatcggcttgaaaacagatccaggctgtctaacagcggtcaccctgttatagccccttgcttgatattctcgtcctccgattgctgctttaactcctccagactcattatcaataaagatggcactgctctcaggagaaccgctttttcccgggaaataacggttgtttttcatcgcatcgtaggtgaccttttgcagattcatatcaatcggaactgttatggtataacccccttgaagcaattgttcatgtgaaatggaatactctgattctgcttccttaatgataagatcgacatagctgtccacccaaggcgtttctgatttctttttcaaatgaatgcctagtgttctcccttttgcttctactgtttcggttgatgataaatacccttgctcattcattaagttcaggatcgtatcccgtctttgtttatttttatcagggtgtaaaacaggcgagtaagtagacggcgcctttggcatcgcagcgagtgtcgcaccttcactgacagttaaatctttcacatctttactaaagtaataattggctgctgcctgaataccgtagacgccatgaccgaagtaaagctgattcaagtacatttcgagcagcttatcctttgaataatctctttctaaattaatcgcaatgatgacttcttttgttttccgcaaaaaggttttgtcatttgtgagaaaaatattttttgcgagctgctgagtaattgtactgccgccctctacctttccacctgctaatatatctcgataaaccgcccttgaaattgactgcgcatctattccatgatgctcataaaaccgcttgtcctcgacagatacaaaggcttttgctactttatcgggtacatcctttattgacacggggtcccgattttctgaatacatacttgtgagttcttttccattctgatcaatgatttgggatgaagcgtgaaatacaagcttcttttcatctatgacataatgtcctaaaaataaaatggtcagatagccaataaatgaaagtacgatggtacttcctgcaatgactaatggaatgattatcttctttttcttcaaattaggtcacctcattcctttatacggatagtatgggatgtattgcttcataatatgttttatggattgactaccaaagaattatatatcattcttttgttatactatcaagcgggaggcggtttagatgaatgtctatatgacatatggaacagcagatttcttgcataaaatcgcaaaaaaacacgatcaggaaaatctgctttatatggtcggaaaagaacaagcagctctttttcatgagacggagggtgagactgtttttaaagcccctcatgcctatgatgtgatttatgcaaaaggtgagcttgtccatactggcttcgtcaccttgaatcatatccctgtgaagcttgaaagcagggcactgtttgaatctactttcaagaagaagacgaacatctcagaacatcagcggggcttcaaggctcttcgagtgttaagaccgaaaaaagatgaagaagtttatttaattatgacgctttgggaatctgaggacttatttgaagactttcaagaatcagaagcattctttcagccaaccgacgatactggctccatcttctcacgtcctgcttatctcacatcctatcatgccgttacagacaattaaggaagtgctgctctcagcacttcttttttcatgaaaaaaagcccaatcgctgggcttttcattttaacgtcgggatgtcagctcgtaccgatgtatgatcggctgaagtacatagaaattcaataggagccatcctaataagatcggccacttcaacataggcgaagcctctttcaattgaatgagcatcaccaatagcggaatcaagcagatcatgaaaaaactcattttcgatacaaaggtttctttgatttgatgccgacagcttggacacatcatcattttcgtatgtgataaatgaaacttttcaacgaaagaaaacacttttgaacaatttgggcagcttcccaatacaattcctccctttccccgcttcatagcaacttcgacttattatgtcaaatgaccttttgatgcgcatacgacatcctcttctgttgaaagattctaacaattaccatacaatcagtaaaagagtatgaaggaggttttcaaatcaatgacaatttctactttacaaaaaagcatcaatgaacgtcttgatgaacattatgaggaaatggttgaaattagacgccatctccacatgaatcctgaactttctttccaggaagaagaaacagccgctttcatcgcaagctactacgacaaattacatatacccacacgtacacaggtgggcggccatggtgttctcgcctttatcgaaggagcttctccgggaccggcgattgccctcagggctgatttcgatgcacttcctatccatgatgaaaaggaagtgccttacaagtcgacaaagcccggtgtaatgcatgcatgcgggcacgatgggcacacagcgacactacttgtcttagcgaaaattttgaatgagcaccgtgatcaattaaaagggaaaatcgtcctcattcatcagcacgcagaagaatatgcgccaggcggcgcaaaaccaatgatcgaagacggctgcttagacggtgtcgatgtcatattcgggacacatctttggtcaccagagccttgtggcacggttctttataaaagcgggaactttatggcagctgccgaccgcttctctatccgagttcaggggaaaggcggacacggcgcccagcctcacttaacgaaagatgctgtccttatcggttcacaaatcgtcgcaaacttgcagcaagtcgtagcccgtaaagtcaatccagttgattctgctgttgtatctgttggaggttttgtggcagagaatgcttttaacgtcattgcagattcagcagttttaactggtactgcacgatccttcgaagaaagtgcacgacacaccatcgaacgagaaattgaacaggttgtaaaaggggtgtgcgacatgcatgatgccggctacacatatgaatatgtaagaggataccctgctgtcaaaaatcatccaaagccgactgaatttattgctgacatcgcaaaacaaacagatggtgtcacagaagtaaaagaagccgaaacccaaatgggtggagaagattttgcttactaccttcagcatatccctggtaccttcttttacacaggcgccatgccggaaaacagcgaagacgtgtatccccatcaccacccgaagtttgatatcaacgaaaaagcaatgcctatcgcagcaaaggtactcgcccgtgccgtcctttcctacgatgattaaaaaaagccgctggcaaacagcggcttttctatttcatttctctcaacacccgtaagtgaaacacatgacgagcgacatctccgagttgtcctgtcaggtgatgatttgctacaccgccaacagcggctccgacgatcggcattaattgaaacagcttcactaggtcaatgtaatctcgatactcctgctgaaagctgtaccaatccattttctcgcggctcgtttcccaatcatctatgatgctcatcattttttgacgatgcgcactgccggaaaaggcaagttgaaatatacagagcaaaaagagtctttcctctttttgagacaaatcaaagccataaatacatgccagttcataaagacatttcatcttgatgctaagcagcagcggaaagtctgccataccgagcaaaataccacctgcacctgttccaattccttcgatcgcagctgccttttgatagtacttcactttctcctttgccagttcattccgctcaatgatggttaattgctcatcaatgactgaaaatgaagtgaagtgagttcctgatacggtggattcaaccattgttttgaccgcacttgtgatgacttgatgaaacctggcagggattcgtcggttcacctgctgctgaactccttttgaaaaccgttcgatctttgatggttttcttaaaaaacgcgtttgaaaaagaatggcttcttcatataactcccgttcagctgcattcatccgttcccctccttgatgtcatcatacgctcgctgtcagtaacatatctctgctacctcatctttttcaatcgactgagtacgtaaggcttgaagaggacaagtacaaatgccagtgaaatcagaagggcaagtccacttccctgccatcctcctgccggtagtactgaacaactgagcacaatcgcttggatgatgagcacgttacggacgagaataaaaaagctccgatccttttcttgatgagtaactggataaagtgcctgtaatgaaagatgggcaaagtgcttcgttaacggcacaagctgaacacctgtgataaacacggtgaacaagacaagcagtgcgcccacccagcctgctgcacctgtatacaaaataatcagcacaaacacggctgttagcctaaacacgagaccaaaatagtcatttgatcgtaagaatgccctcacatacatgtaagaaaaagttttacgctggtcatacggaacaaattgcaaaagccagtccatataggctcttcttttcacctgtttctttaaatgaggcacatctgtaaataagtttgccaaacgataaaaacgctgttttcgttttaattcgtcagaaatatgcaattcccattgaaaaggctgctttttgactgcatttgttaagtaaacaagatagacaccatagatcagataaaaaacgattgcgattgcataggatgcctgtaaaacggtatagattaaaatcatattcaatagaaaacgaaggactgcatcaagccatctcatctgttttccttgaaaatacgtcattctccattgaatggctgtattcaaacccttaatcaaaatcatttgcgccaatataagcacatacatcttaatgccgcctgaagacactgccgaataaagcgggagtgcgacaatggatacggcaatgagaggaaacagctgagaaatgaagctaaagttaaaagcttgttttaaataaggctccatcttcccttccaaaggaagcaaaaacacgagatctgcttctttgatcaacgtccgcacgtaagagcttgtcagcaccaatgagaaaacaactgccatgacccagtaggaaggaaaatgagctggaatttgtttgagccagttactataccagctcgctccgcctgcaaggaaaaaaatgagcacaatgacaagatgatcattgaacatgtattttaaatattttcttgtatcttgtatgtgttcctctaatcgggatttccaaatgctttgtgtcgttttactcatagctttcttcctttgttaattccaaataaagatcatcgagtgtcgcatctctcatattgaactgttctctcagctctgtcagtgttcctttcgctctgatttccccttcgtgcaaaataataaaggaatcacaatagcgttctgctgtcgccaagatatgcgttgacatcaggacactagcgccgtttttctttgcagcattcatccgttcaagcagtgcattgatggcaagaggatcaagacctaagaacggttcatcaatgatatacagttctggttcaacaagaaatgcacacataatcatgaccttctgcttcattccttttgaaaaatgagcagggaaccacttcaaacgtttctccattcgaaattctttcagcaatgacggcagccgttcatctaattgttcttttgatagcccataagccatcgctgtcagctctaaatgctcttttaaagttaattcttcatataatacaggtgtttctggaataaacgtaaactgcgagcgatacgcctcttgatcctcttgaagggttcgtccattcaattcaataacacctttatgcggtttcatgagtccaatgatatggcgaatggttgtacttttccccgccccgtttaaaccgatgagaccgacgatttgatttctttctaattcaaatgagatattttttagaacgggattcttcgtatatccacccgttacatcttttacagtgagaagggacatgaattcgttcctttctttcgtttttcctttatagtaacaaaaacgaaaggtaatttgaaatgtttacctatagacaagtcctgaataaaaaataggcgtcttggtcatcataatgtatgtagaagaaatgaacttgatgaccaataagtaaatgaggtgtttgttaaaggcaaagaaccgcataacaagttggtttttcatctaaaaaccttagcttctgttttgcttcactgattcttgatttttgtgtcctatacaatatgtatacgacaaaccaaaacgtcaaatgaggtgtttacggcagaaatagcaggcatatgaattctttatttcagtaaatagagaattcaaaaggcatatcgaatgaaagcatcagcatttcttctgcaggagcaggatgagcgaccaaaggagttcgcttatcctgttttcttttttgctcatttttgtgatacgatgaaggaaaatgaatgaggagtgacatgacgtgagcgattgtattttttgcaagatcattgatggagacattccatgtgcaaaagtatatgaagacgagcatgtattggcttttctagatattagccaagtaacaaaagggcatacccttgtaatcccgaaaatacataaagaaaacatctacgaaatgacaccagaagtgtctaatcactacttccaagcgattccgaaaattgcaagagccatcaaacaggaatttgaacccattggattaaaccttttaaacaacaacggcgaaaaagctggacaatctgtgttccattaccatatgcatatcattccgcgttacggcaaaggcgatggctttggtgccgtatggaaatcacatcaagatcaatacacgtcagaggatttaaaagacatttcttctgccatccatactcgccttacctcatcttaatagatgaggtttttctcatttctgccccctctttttatccccttcatttcttaatagtaagatatttagaacgattcaaattttttgtccaattgcttcaaatttgtgataggatggttttatcttttgatccattaacgcgagaaatagggagagattgtgatgaagcgaacgacgaattttaatgctggtccggcggcactgccgctagaagtgcttcaaaaagcacaggaagaacttgttgattttaaacaaactggaatgtctgtgatggagctgtctcatcgcagcggtgaatatgaagaagtccacaataaggcaaaagcactgttggtggaactgatggacattcctgaagattatgaagtcctctttttacagggcggagctagccttcaatttgctatgattcctatgaacttcttacatgaaggcgaaacggctcatttcattcaaacaggcgcttggtcagaaaaagcattatcagaagcaaaagggtttggtgaaacatctgtgtttgcttcaagtgaagacgacaactactcgtatattccagaagtagatgcctccgatttaacagatggcgcttacttacacatcacatcaaacaatacgatcttcggcactcagtggaaaacgttccctggtacatcattaccgctcattgcggatatgtccagtgatattctcagcaaaaaaatcgatgtttctcaatttgatctcatttatgctggggcacaaaaaaacttagggccttctggtatcacgattgtgatcgcgcgcaaacgtttattagaaaaagagaaaagcagcacaccgaaaatattaaaatattcaacacacgcaaaagctggctctctttatcacacaccaccgacttttgcgatttatatgctgtctcttgtccttgaccatgtcaaacaggctggcggtgtagaagcagcggaaaaacgcaatgaacaaaaagcaggcattctctatgacacaattgatcaaagcggcggtttttacaaaggacacgcacgcactgacagccgatcgcatatgaatgtcacgtttacccttcgtgatgatgcgctcactgcttcctttgtagagaaagcaaagcaggaacaaatggttggacttgccggccaccgttctgtcggtggatgcagagcttctatttacaatgcggtatcgattgaagactgccaaaagcttgcggactttatgaaaaagttccagcaagaaaatgagtgaaaaagcttttctatagagaaataaatttgttataataacgagaaatataaagtgatgactcttgcaataaatgatgagccatattattggagagttctaagagcttagcagaggagagcatagaaatgaaaacaaaagaattagtgattatgtcattgcttgcagcaatgggagctgttttgcatacgattttcccgcccatctttttcggaatgaaacctgatatgatgctggtcatgatgtttttaagcatcatccttttcccaaaggtacagcatgtagtggttattgccctcgtaactggcgccatttctgcattaacaacaggtttcccaggcggacaaattccaaatatgattgataaaccagtgacagcctttatcttcttagcccttttcctatcttgcatgaagataaagaacaaagtagtgcttaccgctgtgttaactgcgattggaaccatcgtatccggcgtgattttcttatctgccgcattactgatcactggactgccagctgcattaccggcacttcttgtaggcgtcgtcctgccagcagccgtgattaataccattgccatggtatttgtcttcccaattgcacagtccattctcagacgtgcaagaatgatagaagttgcttaacgaataatcgaacctcttcataatagatgaagaggtttttttcatgcttttataaaagaaaaagggttagcagcaaaatgaggagcgaaattcctgcacctgccgcacacacaagtgctttttgctttaatacatgttttggcggataagaccctgcataccccagctgtcttgcataatgaatagaaccacctgtaaaaacgacaccgatacacgtaaaaacgaacagaaagacagacaaccttctcccctcccttttcttcaaaagtatgctaaaataaagcaagctatgtatggaagttcaatgaagctgatcgtcagctcagagagaacatgcgaatgtgtaaaatttgactagaggtgatttgaatggctagtggacgttctttattaacaggattatttgtaggcggtctcctcggaggtgcggcagtgctcctgacgactccctcttctggcagagatgtgcgcggaaagatgaaagacggctatgacaaattcgaagatacgctgacaagattaaaaagagatggacaagctttaaaagagcaaattgttgaaacagcaaaagaaagcgcagaggttattaaagaagtcggaactgaattacaaacatcgattcagcaatggcgcgaagaaatcaaacctcatcagcaggatttgcaaaaggaaattcaggaaattgaggaaaagctcaaacaactggagaaaaccttacaaaactaatatactcaagaaaaaatattcgtttacaaaagtgtgcggggtgcgtatcccgcactttttttgttgaaaaaaggttattttgtcaatgtttttcatgagttttaaaaattcttgaattttcagctttattaatctttattttattggcataatagaattacaagaaaaagagaagtaggtgaaatggatgaatcattcggaacagcctttcgatgtaaaagaagcacttttattcagtcaaagaatggcccaattgagcaaagctctttggaaatccattgaaaaggactggcagcagtggatcaaaccgtataacctaaatatcaatgaacatcatattttgtggattgcgtatcaattaaaaggagcttcaatatcagaaattgcaaagtttggcgtcatgcatgtatcaacggcgtttaacttctccaagaaactggaggaacgaggatttttaaaattttctaaaaagttaaacgataaacgcaatacgtatattgagctaacgccaaaaggcgaagagacattccataaactactcgaagattatgacccggcacgaactggtattgtcaaaggcgcacagccgcttcatgacatttacggaaagttccctgagattttagaaatgatgtgtattatccgaaacatctatggtgaggacttcatggagatttttgagaaatcgttttcaaacattgagaaagactttttgaatgagcgaggaaaagtcacgaaaaaacctgaggaacttgaagactcagctgatgcagcagaaaaagcggctaaagcaaatcaaattgtttaatgatctttataaattcattcattaacggctgaaacagcccttgatcatgcaatgcaaatatcgtctcatgcacatccagcttttcaattaactgtcctgcaaaaagcgcaagcatatcgtcaaacatgacgtagccttgtgctttttgcttgtccatttcctctgaaagctcagcacaaatacgctcaatttcctgcgcctcttctttcgatacccgctgtctgatcaataatgcataatatggataacggctcatatcggtcgccgtcagcaaaagttccatataatattcgagctggctcattcgttcctcaatactcatgtacgttccctctttctcttagtctttctattctagccgaaattactcattgacgaaagagacgaacctccctcttctgtctttttttcttgaaaaacccaaagtttcctctctttattccatatgaaggcaacattttatttttttttcatgaaaaccattgatttttatcctcaggaagagtaaattatcttgagatattcaattagttttttaagattggaaggatgaaaaatgaattgttggaagaccattaatcttgaaaaggattatggttatacaagactgctgatttcagccataagtcttgctatactttttttcattacggcttttttatgttttcaactgactcatcctgaaacgagactaagcagtcacaacgcaccgctttttgctatgcttttacttgtgacattgcttgtccaccgtgtggttcacttgatcccagtgatgaaaaacaagaaaaaaatgacgctatttaaacgaaattgctggcagcgtgtgccaaagaacatcatgctttattcacttctcagtccattttgtgtgatttcaccggtttactttgtgttaggtgtggcgcttcctatgtatgcacactattttatcatcatcgcaagtattcatgcaggctattgtttgcctgactttttatttgcatggaaactgcttaaagcacctaaatcctgcatcatcgatcaagcccaagacgagtttgatattttagttgaccaaacatcctcatcatgaggtttttaaagccaacttctatctttttcataaaaaatttggtaatgtagtatgggaatagcatagagaggggggatctccgatagttttattttacttcatcgtctttgccgcgtttattgtgtattcaataaacaggcttactaatacattatgccttgtcagagagattcctgaagaacggcaagataaggtgtttcgctttatcaatgtatcgatactgatcttactgatctcatcatttgttgaaattaccatatctatttaagatcaaagcaaaagctgccagtttgagggcagctttttgtgtatattgattaattagcaaatccaagatgcaccgataatgatcaataagatgaataacacgacgactagtgcaaaaccgccagcgaagacttctcctcccatgtaaaaacacctcctgccagttcttcctctgttctaagctcagtgtatgcaataaaattgaaaacgtttaggcacctgtcatcgtttaaaaaaagaaccgcccgcacgcatggcaggacggctcctttctgtcacagcgatttaattaataaagatatgctgcaccaacgatgatcagcaaaatgaatagcacgaccaataaagcaaatccattagaatatcctgctcccatataattcagcctcctttttgtgatcactatatgtgtatgttgcgcgcaaatttttgactagacgaatgccctcccatttgcatttctttttacagcgtgtcacaatatgttatgatacaagcaatgataaataaattggaaagattaggagtgttttttgaatgaaaaaaatggctttagcagctgtaacagcagttagtgttttaactcttggcgcatgcagtagcggtgataaagatgtcatcgcaacaacaaaatcaggagatgtcacaaaagaagagctttatacaactcttaagaaacaagcaggtggagatgctttaaatctacttgttcaacaaaaggttcttgctgacaaatacaaagtatctgataaagaaattgataagaaaatggaagaatataaaaagacacttggtgaagatcgtttaaaacaacttcaagatgaattcggaaaagattacatcaaagatcaagtaaaatatgagctgctgactcaaaaggctgccaaagctaacatcaaaatcactgataaagaagtaaaagcgtattacgatgacctaaaaggcaaaatccgcgcaagccacattttagtagctgataagaaaacagctgacgaagtggaaaagaaattagataaaggtgaaaaatgggatgctgttgtgtctgaatattcaactgataccgcttcagctgcacaaggcggagatgtaggctggttcgcaaaagaaggtcaaatggacgaaaacttcagtaaagctgcattcaaactaaaagtgaatgaaatcagcaaaccagtgaaatcacaattcggctaccatatcattaaaaagaccgaagaacgcggtaaatacgatgacatgaaagcagacttgaaaaaggaactaactaatcaaaaacaagcagacacaaatgaaatccaaaccatcttaaacaaattggtgaaagatgcagatgtgaaagtaaaagataaagagcttgaaaacacgttcaaagaaaagtctcaacaacccgcacaaaatcaacaaggtcaataatcacaaaaaaccccctctgcaatgaacgtgcagagggggttttttatgaccagatttaagcaatcgagtgatcttcatgtgccgacgtttcctgggatcttttcacttgctccccctgacgtctgcgctctctttcttgctccattcgctcgataaaaatttctccttccttttcaataaaggattgatcaatctcttgctcctctttggccgttgtcattaatttatacgcacagaaaataatgccaatgatacatgcatacacccaccatggaaaaaacaacattttttcatcgcctcctttttttcagaacagctctctcttcccttgtgttacatgcttatgcaaagagaagacaagttatgaaaaaaacgcccgcataagcggacgttttgacatggttattcgtgaaaggttggtttataaaatgaacgattctctagcgcaaaaatacgttctgtatattctcctggcttcacatgctcaagcgcacgatccatcatattcatcttcgcatctaaattatcaatatagtggagaatttcggcttcctttaccattggtggttttgggctaccccactctccttttccgtgatgacttaggactaagtgctgtagaatcagaatttcttctgaatcaatgccaagctcctcagcagctttcgcaatttctgtcaccataatcgaaatatgaccaattaaattcccttccaccgtataggtggttgagactgggcctgaaagctctttgacttttcctaaatcatgaagaatgatgcctgaatataaaagatctcgatctaaagatggatatagatcaacaattgatttagccaaatgcagcatagacaccacgtgataagcaagaccagagacaaattcgtgatggttttttgtcgctgctggatagtcagcgaattcctgtccatatttttttagcaaatgtcttgtgacacgctgtatattagggtttttcatatcaaaaatatattgcataatcgtatccatcatatcatgctttggaataggagctgtttcgagaaaatcatcgattcgaatttgctcattttcagcaacagggcgtatattcctaagtttcagctgattcctcccgcgataatgatgaatatcgcctactaccttcacaatggtttgtgcggcataggtttgttcatcattctgcttcgcatcccatagtttcgcctcaatatctccactttgatcttgaagaattaacgttaaaaatggtttgccattactcgcaatccctttagtagatgatttaattaataaatgcaggtcaacttgttcgccgacatcataggtcatgatccctttagccattcaataaaagctccttccatgtttctgctcatataagtataacataagtcattatttgtcaatcattccactgctaaactcgtaacctgtccatcttctgccgcttgcttcatatgctcatgacaggtgaaataaaacagctgtgtttcaaaacgtgtgagttcgttcatcatctccagcaatctgcctaaacgcacgtgatcgaaatgaacaaagctgtcatccatcataaacggaagctgacaatcttgctgatgagacaaagcaagcgcaaaacgaatcgctagatagacctgttcacacgttgcctgtgaaagctcctctggacggaatagtcgtccatccattcttttcaccatcaggaaatcatcttcaggtgaaaacaaaattgcttcataacgatcatttgttaacggttgaataaaactagaggctgtttgaagcaatgcaggcagccttgtttctttatgctcattcaatttttctcgtatgacggagcggacaagctgaatggccgcccatttttttgcgaggtgcttcgcatgctcctgctctgcggcaagctgatgagtcaaatcagacaccgttccagaagcttctatttgccggatttccactgctagttctgctaaacgcttttccagattctccgcattcaattgaatgtcatgaaggtgctgctttgcttctgcacactcctcctcaaggagaagtagtcctttgcgaataatccattcctcctcatcaaaacaaccgcttctatgaagctcttgattcagctgctgcagctccaaaagccgttcccggtattctttcgatagatgagaaagtacttggtaatcttctttggactctgcttctacttgatgaaaaagctcatcagtttgtttttcgtaatattgaatttcactttctagtgtcgcgagctgctgcatcgcatgttgaatggatacatgtaatgtttgacgttctttttctcttttcgcctcatcttccaatatctcttgaaaggctgaaatattctcctgcatagttccttcctttttttgaaaaatactggttaacgctgaaaccttgcgctcataaatcgattgctgatcggagagttcttctatttcacgctgaagctcctcatatgccgctgtattgatttttaattgttttagaatatggaaggcctctactaggaaagaaagctcagacgacaagccaagctgtctcttcttttcctctacttgctgctggacaggctccagctctagctcccagtcttcatattgccggatgattctttcgtacagcagctccttctgcctcataagtgtttcagctgaagctgcctgcacttgaaaggaatctaaggcggcttcgccgtttctttgtttcatagggctcatttgactggatgagtaaatgacaaagaagagaaaaacagaaaatcccgcaaacgagagcgtgatccaccactctgttaaaaagaatagaacaaacagaaacaccacatcaaatgcgatcaagccttggaataacaacgccagggaataaacccgtttctttttcgatcttgtccccttcgcttcatcttctgctccgcgcagtctcacttcttgttcctttaatccttttagcgcggattctgcttcgtccagctcatgtcttgcgtgatcaaatcgttcatctaactgcgcttttctgtccatgagacgaacgtattgagtgacagtctcctttaattcccactcgaattcaagcgaatcgtcgatttgttcgagctttatcgggcgctcccagtttaactttgcgaccgcttcgtctattttttgtttcaatgaatcacggtttgcttgacactctgctatgcgctttttcacaagctcaacattagatgcttcatctacgactcgtttcatctccataaaggtttccttgtcataaagcggttgaacttgtacgagtgaggtttgcaaatgatctaacctctgtttcagtgcagtcaattgagcctttttcgggtgaaggtgtgagtctaatttatccagctcatgctcagtttctgctctaaaacgtttgacacggtctggatagcgggctaattcctttttcaactccacttttttctcaatcatgggatacacttgaatggattcagtcagtttctgaaggtgttcttccgcttgcttcatttcattttgaagcttttcgatcgtctccgttaattcagaatgctcccgtttcttatcgatatagctgccttctgccaatctcgcttgtttcagctgacctgccagctcttttaagcgatcaagctgctgatttaattcaggtttgcggccatttggtttaaacagctgctcctgctgctttagcagcctgctatccatcttggtggctgcatctgagccaaataaacttgagaaaagtagaaattcgcctatctggtcctgattcaaggcttggacattttgaagtccaaacacatcaaacgaatagattgattgatataatctgcgatccgttccctttaaaagtgtttgtagaaaagcttcgtctttcacttcaccattcggtaaaaacacctgtgcttgcccaccgcgatcggatgttctctcaatatggatgacgcctaactcgtcatcttggcaagtgagggaaccaccataaaaagaaccctgcttcgtcttgtacatcttgtttttcggaaaaccaaataacatcgattcaataaacgttttcaatgtcgttttccccgattcattcagcccgtaaactagctgaaaaccgtcatcagaaaagtgaaaggtccgatttgaaaattttccaaaatgggcgatatggagtgaacgtattttcattgtgcctctccttttctcataattgcttaagctgttctgtcagcagcctttgtgcttcttcttttatatccacttcatcctcttttgtaagagcttttcctgactttctataggttgggtgacgcttgatcggtgatagaagctcttcatatacctcaaactgtgaaatttcagcagtgagttcctttaaaaaggaatcttctggataggcgacgtcctcgtttgtctggcagtcaatcgatatcacccaaacgaatacatcttcatcttcctcctgttcatgaagaacggccatcagctcctcaagcaactcaagctgcgtatgctcaaagtaagaaggagaatcacccgtcaattcaattttcacaaaatgagggacgccttcttctttcagttcaatgattttgttatccacaagtgtcacaagatccgtcatatgaaccgtctctgtgatgtctatttcaagtgtctcaaacatcacatccgcacagctaataaattccgctgccgcagaatcctcagagagttgaacaacgtaacagcctttctctcctgtttcttttatatgtctgccctgcatgttaccagggtaaataatcaacgggtcttcatgcagaagagctctcttatgtatatgtccaagcgcccaataatcgaaatctcgggaaaggagctgctcaagctgaaaaggtgcatatgcgtcatgaccttcttgtccagctaatgtaccgtgaagcatcgcaatgtgataggcagcatctgtctttttgacataatgagaggtcatattttcatagacagcacgctctttgtagctaaatccataaatacttgcgacaagctgatctcctctatagtaggattgctcacttggggtactggttgaaaaaacgtgcacattctcaggccactcaatcggtgtccattcaccgcctaaatgatcatgattaccataaataataaagacttcaatcccttcggtttgcagtcttagaaactgatttcttaaaaacagctgtgctttcaggctgcggttagattcgtcaaataaatctccgctcagcagcacaaagtctactgctcgagcaatggcgagatcaaacatattcttcgcactttgaaatgtactttctttgagccgcttaaagggtaagctagggatattcgacattcctgcaaatggactgtctaaatgtaaatctgcggcatgaataaaggtgagcttagtcaaaagtctatctccttgtccgatactgtcattgtccatattttatcatgccatttttgcgaatgcacgttctatcactctcattctaaaaaacacatttttaaggggtaaaaaagaggttttgtcttattccttgtttaattacatagaaaagcagaggaaaggaagatgaggaatggagaagacatactttttaactgtatttgacccgtcaggtgagactttactaaatgaaaaaatcacaacagatagtgatgaaaaggcaaaggaattaggtcgccatcgcttattagaacagcaatacacgaagcattctcatcggctcgttgatgatgcaggcaagctgcttttatttgaacgttaaaaaagccggcattcgccggcctcacattcgtttatacattctggaacacaggtcgtcttttttctaaaaaggcctgaatgccttccttatgatcatggctttgcctcagtctagcctgtgctgccctctccttttgaagaacggctagcagctgtgattctgactgctggaaatagattcgctttgtctcgataaatgcttgaagcggcatgttcataaacggcttcacacataccttttgatgcgcatcaacttcctcttgaaatacgccgtctgcaaggcgcagctttagcgcttcttctgccggaagcttttgtccgctccaaatcaattgtttcgcggtttgttcactgactctttttgtgaggaaaaaatgccctccgccatctggaattaagcctactccattaaaattcatggcgagttttgcatcttgatgcataaacaagtagtcacagcttaaagcaaagctaaaagcaaggcctgccgctgacccgtggacaagggcaatcgtcacttttttcataccagctaaagaaagcgtaatcccctcgatcaaatccatcacacgatggaaatcctcttcactttcctgcttaagcatcatgccaatatctccgcctgctgaaaatccttttcccgcacccttgatcacaacgacttttgcactactatcctccgccgcatcacatgcctctttgaattcagcaaacatctccacatgaaatgaattgtaagcatccggcctattgaaaacgatttcaaaaatatccccgtctagctgacaattgatatatgtcatcatccatcccccttttttaaacacatgacttacttccatttcaacccgaataatcctttttcctctgcataaaaaatttcaggatcagttgataccaaaacaagcataattattgaaacgaaaaatatatttttatatagtaaatgaagaaagaaattgatggtgaaaggaggagaatggttgatcaggtgttccctattcatattagttcatttcatcgtcatgttttctcctttttcaaatgtcgtttttgctccacaagcagaagcgagcacacctagtcttatttctccatccatctacgatgaagaaatacacgctgtgaagacacctccattttcaaaaaaacatgcctcttctattctattaaaggacaaattatcactggctgattcaaagatttttcttctaaagcctgctccatcagctgtgttatcgattgatctatgttttttgaaaatgaagtgtgcgatccccattatgtatcaatcaaattatctatactgattcattttatttcatccgtattcactatatgaaaatcacaacctatcatattcggagggataaaatgaatattaaagaaaatgatcttcctgggatcggaaagaaatttgaaattgaaacgagaaatagagaaaagatgacgatcgtgattcatgatgatggcagacgggagatttatcgttttgatgatgatgatccagatgaagtgctgtccaccatttctctcgatgatgctgaatcacggcaaatcgctgcaattattggcggcatggtgtataaaccacaggcactcgaaaccattgaaatggccttcaacgacttgatgattgaatggtttaaggtggaaaaagaagcaaaagcggttggacatacactcggtgatttagatgtgcggcaaaactatgaagtcaccgtcattgcgatcataaagcatacaaatgaaaaattactcaaccctggtgccgaatcgattattgaagcaaatgatacgctggtcatttcaggcgaaagaaaacacttaaagcgattgatacgtgattttctttcaagagggggagagtgatgaatggatcatttagtctttgaagttgggacggcactgattctcatcgccatcgccagcttaatcgccaataaaatgaaattctcaatcattcctttcctcattgtccttggtatgatcgttggtccgcatgctccaaccattgggatcattgatctaaaatttattgaaagcaccgacattatttcgttttttggcagaatgggcgtcttgttccttcttttctaccttggacttgagttctctgcgggaaagctcattaaatcgggcaagtccattgctgtcggcggatctatatatattttgattaacttcagcttaggactgctttacggctttattacagggtttggggtcctcgaagttctcattatggcaggagttatcacgatttcatccagtgccattgtggccaaagttcttgttgatttgaaacggacagcgaaccctgaaactgagttaattcttgggatcatcatgtttgaggatattttcctcgctgtttatttatccgtcgtatccggtcttgtccttggagatgccacaactgttggcggtgcattattatctattttcattgcttttggttatatgatgcttttctttatcattgcacgtaagctgccgaaacgattaaacaagttattcgatatccgttcgaacgaagtgttcatcattgtgatttttgcggctttattttttgtcgcgggtttctcagagacgatccatgtagcagaggccattggtgctctcttacttggtcttgttttctcagaaacagagcacgctgaccgcattgaacatcttgtggtaccatttagagatttcttcggagccatgtttttcttcagcttcggtctcagcattgatccatttacattaggtgatgcattttggcttgcgattggcgctgtggtcctcaccttcattgggaatttcactgctggaatgttcgctgggagaagagctggattttctcataaagcgtcttctaatattggtttaaccatcgtatcacgcggagagttttcaattattgtagccgagctcggtattgcgggcggacttgccgctaccttaaagccatttgctgcattgtatgtcttaatccttgcgatattaggtccactagtgacgaaggaatctaagcgaatctatcaaatcctaaacaaagtgttcaaatggcaaacagaaaaaccaaaagcgaaaaaagaaacgacaatctaatgaaaaagggccctatgcttgggccctttttatctcttattcaaattgctgaaaagctgtttcttgcttgactggcgcttctttgaccccgcgaatcgtttgaatcactttctggttgcggtagatggatagttttaaattggtcgccgctgttccatgagagtgatctaggtgcgtgaatgtaaagaaatgatgcggacgcttgtctttgaacacaagcctgaagtcttttgtcactttaaaatgttcctcactttcccattcaatcaaaggttcatacgcactaaaccacgccgggatattcggtgtgtaccctgtagccaatacggcacgatctactgttatactcttttctttctttagctgccactgctttagtttcagcttcagagactgattctcctccacctgaatcgcttcaagctcggtcattggctgaataatcacagatggctcttcgccagaaacagaccgatgatacaattcttgataaatgcgtgagagcgtcgatgcatctatcccatttcttaatccagtcagcctaggcaatgtgttcattcgttcttcataaggaagcgaatggaaatattcaacgtactttggtgtaaatagctcctgaccaagctcagccgtctctagctctctaaattcactagatcgcgtaaaccaagatagctgctgccctttcttctgatgctgaagcaagtctaagaagatttcggctgcactctgcccagagccaatcaccgtcaccgactcagcttcatgaagttctttctgctggtctaaataccggctgctatgggtcacatttggcagtgcagcatcaggcacatcgacaggaatcatcggtttgctccctgttccaagcacgacatgctttgcccgatactcagaaagcgatccatcctttaagcacctgactttcacaagataaccaccttgacagtccgtcacttcttctaccttcatgccaaattgacagctatctatttcacctgcgacccatgataaatactcattgaattctcttcgcggaatgtcaaactgttcaaatgtatagaaccggtgaagtctattggattcatgtaaataatttaaaaatgtatatctgctccttggattcgccatcgtcacaagatcagctaaaaaggagacttgtaaatccgttcctttgatcagcataccaggatgccaggcaaattcagactcctgttcaaaaaaacagcatgaaacatcttcatactcctctaacaaagccgccaaacctaaattggcaggtccaatcccaattccgatcacatcaatcatatgtacacctgctttaactttttatcacttatatacccttttacaaatgaaaaaaacactacgtcaccgcagtgtttaaacgtgaggaacaaataatgactcaagaaattgaattttctcttcagtatagtgttcataacggtcattatatgattttggatcttttggattggcatattgcgtaatttttcctgaacgtggatcaatgaatttactagcagcaccgcatccaatcccaatgattgtctgcacttcttccataataatgatattatacaaactttcctgtccatctaatgaatacccgacattttcaaggttccctaagatgtttttttgtctatataaataataaggatgatagtcatgtgctttcgtccaagcgaccgcttcatccatcatacgtgtgatttcttctcggtcagctacttgatatttgtccttattgcgcgtcatctcagacgctcttttaaaggagagcgtatgcacagttaaagattcaggcttaagttcttcagtctgctgcaaggaatgctggaattcctttagcccttctcccggcaaaccaataattaagtccatattaatgttattcatgccatactgtcttgataagtgatacttttcaatcgtttcttctacactatggtgacggccaatggctttcagtgtttcattctcatacgattgtggattgatactaatccggtcaatatgatatcggtttagcacctctagcttatcaggcgaaatcgtatcaggacgccctgcttcgacagtcacttcccgtatatgtttcacatcagggaatgagcggtacatttcttcatacagtaaatccatttcttccgcagtgatacttgtcggcgtacctccgccaaagtaaacggtcgtcactttaatcccatgttcttttagccaagtaccgattttttgcatctcataatgcagaccaaacaaaaacgttcccactcttccagcttgtcctttaatcgcataagcaggaaacgtgcaataagcgcattttgttgggcagaaaggaataccaatataaatacttacctcctgctgaaggtcatacaggtcaggaatcgcttgaagctgacgatcgacaatctcctgcatcaaatcgattttttcatcatgaatcaaataatcacgctttaatgcggcatgcgcatcttcctttgtcataccatctctcagcatcttatgaagtaattttgtaggacgtatccctgtgagaatcccccacttttgcgtcattcctgtgtgctcctgaagcagatgtaaataaacagacagcactgtgtttttaatttgcttccagcgctccttgtcgttcaatccctctgggacgtctcgcgaaaaacgactagtgatgtctgtttcagcgatgtgaccagatgcctccaccgttccattttcttctttccagctaaactccatgactagtccatcatgcaattcatctggaccaaacagcacttcactatcttcttcaaataaattggctatattgacaagcgggcgatgaaatcgttcatctgacagccctttaattaaaattcgcatcgtatcacctttatcttcaaacttgtttcattttacaaaatctatgtaggaaaagcaatgactggaacagttgaaggccctgccatttcttgattgacaggaccttcgtctatattatcgcttaatatcgaattgatgtaaaaatccttctctttgctgcattctaaagtattctttgatcatataagcgactccctgttcatcgtgtgaacgtgtcacccaatcggctttacgtttaacagaatgaggtgcatttcccatcgcaacgcctaagccagccaattcgagcattggaatatcatctattccctgcccaatgaccaccgtatcttctaatgtcaaacctaaggctgaggtcaaaagagaaacccccgcttcttttgatacgcctttgcatacaatattcattttctcatcactaatccgaataagatcgacagatggaaaagcttgttgaatggttcggtgaatttcagcctgaagctctgcggttgaatacacttcaatcactggtgtactgaccggttcatccatcagcatatcacttagcgattcaacaaattgcacgggatagaaaattggatcagacggatgaatcaacgtctttcccatcagctgtgactgcgtttttttccggttgccaatcgagaatttttcatgcagcaagcgaacattacaatcaaagctttcaagaatttgcacaagattaaatgttttttcttccgttagtttcttcacatgaagcggctcatcgagtttattcgcgataaatgcaccactatgcgttacaagggttgtcgttggaatcttcaacgccttggcaattttttgtgcggaacgaaaatgccgattggtgacaagcgtcacgtaaaccccttttttctttacatattccacagcttcttttgtagcggaatggatttttccattggaacgaagtaacgttccatctatattgagtgcaagtagtttttttgacactgaggcatcccccttcttgatgactgtacttacgatgaggatatgccctagcttggtgctttagaacatgcagttgaaagagccctgtgtgttatgaatcttttgcaaataaaaaaagcctacccctaggcttttttttatgtatggtttggatgcgtcacaatgaggtgatgaagctccccatgatccccttatctttcacacaccaaagcattgcttatatcagatccccttatgctttgcgtttctcccagaagcgcttctctctcgtttggctaatcgccttaaatcccaagtgaaacgcacccaattgtcccatgagagcgcttatttgaaagcactttcaatataagtattatcgcagaatttatgagcttcgacaacctttttttgaaaagttggacagggaacatgtgaaataaaaaagggcgaatatcatcgcccttttcattaattttcttctggattcccataaagctcttcaagaggcttcatgatcactttatttaattctccgatgagaacactcacacgttgttctgcttccatcaactgagagattttatcgtgctgttgaacaagtgccactgttttttgtgcttgctccacttcttcttgtgtgatctcttgaccagtcatttgtttttgttgaaggtttacttgaatgtcacggaagttctcgaacattcttttagaggactcatccgcgttaacctcatcataaagattttttagagttgagtattcttcgctatgacgcaatgctttttcaaggtcatatgcaacatcataaacatttacagacatgttatgtctcctttctatccgttatcaccgatatgatcggcggacaccactccactataacaaactatggctttcgtttcacatatatacaacgaattcattaaaatttctctagtctgtcttaaaataacgtgacaaagattgcttggattgcgccgattaatccccctaaaaaaccacctaaaaacgtgatcatcttaagttcattgttggaaatgctaacgacaagctcctccatttttttaagcggaaacagttcaatctgctcacgaatgatatcttcaaacttgagctttgcgagcagtccctctaatgcatttgatgctgctttaatccccttatcgacaagcactggtgctaagtgtattttgagatcaaccgctactacgctgacataagatccaactggcttgtctaatatcagctttgtagagaagtgtgaaagcaattgctttttcacactataagcaagctccttcacattccatttatcatccagttcctgaagagaaaattgtttcaccttgtcccattcctgaacgagcaaatctgataaaaacctctttgtttctgcatttcttaaaaacttaatgatttcaggatgtacacggtcaattaagcttgaatttcctaaaaacatttgaaccataccgccaagcatgccgcgttcttttaagaaatcaccaatcatattgccaagcctcgctttaccttcttcactttcaaagtaatggatgcctctctttaaaatataatctgctgcatctggaatttttgacgaaattttgttttctacttctaatgggagtaactcagataacgtttgctcattatatttttttagcaatgaatcgagcttctgatcagaccaatgatgaatccattcatctgctttgacgtcagcatgtgatacaccgaatctttctaacaaagagagcattgtgatctccatgtcagcgcctttatcaatcaatcgatgaactgtatgcaagatctcctgcttagcctcagatgattcaaatcgcttttgaataccttctggcgtgagcaaatgctccataaccaagacgccaacctgcttggctacttcatctcttcttttaggaatgagccctggtgtaaaaggaagctgtttcccgaataagtaatacggcttataaggacgaaaaagcattttaatcgcaagatggtttgtcgctgctcctataacggcacctataacaatcataaagataaaggttgtgaatatattcaaagtcgtcatctacctttcaaacaatacccgatgtttattggtttaatctatacgtattatagttgttgtcatgtcctcaagcaaatgaagcatgctgctagacatatgatcaatcgatctgtcgtaatgataaagaagcgcaatctttatgtaaaatcatgaaaatgtgtttttctgctggtaaaaaaagaagttgaaaagaaggtgttttttaatgacatcaacattaggtattgtgacgctttcaccgaagtatgaagagggattcacacgtgggctagccaaagctgcccctgcttatggtttaaaggttgtccgttttacaccacttgatttaaagccggcttcaaatttaatacaaggtcaaacatatacgaatggtcaaggattcaccgcagcagaatttgaaattcctgacttgatttacgatcgatgcctttacaagcatgacgcacaatctaaaaaagcaaaaccaatcatggaatggctgaaaaagtatccgaaaacagattttttgaatacaggtatttcaaataaaatgatgctattcgagcagctccgccttctccctgctttacagccatacttacctgtctgctcattattaaaagagccatcagaccttctcagcatgttaagcaaagacggttattgtaaaatgcagccgctctctcaacaacatgcagcatctacttacttcattttcttaaaagacagcactttcactgttcagctaagtcccgaacaagtcatcacattttcgcgtccatcagatatagagcgctggtgcagaaagtatgtaggccgatatttccttcaattttttcagacgagtgatcaaaaagactttttattcaatgaaataaggattttcctgatgaaagattcacaaaatcagtggaatcgcatagggattcacacaaaatcacctacagaaaataatcatttaagcattacacaaaaatcagcatccatgataggctttgatcactatctaaacaccttgcagccgcacatcaaagagcttcttttagatgatattgcatccattcaagcatctctgctagcatatatagataaaaccctttccccttgctttgaattcgctgtagacttactccatacaagtgaaggcaggcttttcatatcaaatataagatcaaaaccagggcgatccgcttttttaaaagcttatcctgacaaggaaaatgaattgattcgtaccattcttgcacatgcacagtcgatgaagtcacaaccgaaggaggtttctcatgaacaaaaatcgttacatcatcgccactcatcccgcaagtgaaaaaacaattcatcttcccatccattttaaaaagcaggaggcgatctattctcttgctttaggttctcgtctagtagatgacttcaccgtttcctatcatcaacatccaactaaaattttattatcagaagatctatatagagatttattcattccttatcaatcaaaagctgatgtgatagccattgatcataccctgttcatagggccactgcttggtattttcaccgcaggttttgagcaaagcacgcagccactaggaacgagatcagacttttttatcaaactgctgcgctctttcaaacagcatgccggttttgcttatctttttgggacacattctattgattgggataaaggaatagtagaaggattgttgtaccaacagcaaacatgggttaaaaaacaaatgcccctgccttcagtcatttacgatcgtcttccaaatagaaaggctgctcagtcagcattcattcaagaaacaaagcgcaaactcactcaagactatgatattccttggttcaaccctcatttttttaataaatgggacattcatgaacaattgttaacagatgaaaaaacatgtccttttcttccacattccatacaattggacccggtggacactctaaataaaatagaaacactcctccatctacatcaggtcatttacttaaaaccgtcgaacggcagtcatggcgacggtatttatcaattaaacaagaaggctcatggaatcactgtatgctcaaatcaaggaagggctgttccatatgactctttagaggatttcgttatcaatctccggaaagatcacgcaattcaagattttatggctcaacaaggcattgcacttcttcaaatagacaatcaaccaatggatttcagagttcataccaataaaaataagtacggtcattggacagtcacagcagtagcagcaaaaatttctggcaatcacaccgtcacgactcaccattcacatggaggctcggtgaaaacactttatgatgtttttccagaaaagaagaagcgtttgaaaatcttagagcagctttcttatactgctatcacgcttagtcaggtaattgatgaaaaattgtccggtcatattggtgaaatcggttttgatttaggtattgatcggacaggagctatctggatgtttgaagccaattctcgccctggccgagaggttttccagcatgtctcattgcgaaactcagaaaggctgattggaaaaagaatcatggattacgcctcttacctttcacaaacgaccttaacaactacagaccacacaaacatctattgacaggtttttaaaaaagtaagggtgtgatgaaatctatgcttttcctatgctcttttcatcagatgagatacaataaaatcaagttcaagattgtttccgtattgtcgtgtttatttattgtttcatcaataaaagcaaggaggcaatgatgatatgatttctcattttcaatggaaacctctctttaaaaaagcacaattgccaggctggaaaatatccttttttcacaatggtgcgcactacgaaggcatctaccacaaaacaggtgatattgaatggggctctcagcttccgcctcatgaaatcgaaccaaccttaaaagaagaaatccacgaattaatgctattccatgtctatgattaaactgtttaaggagcttcgccatgttagaaaaattaaagcttgtttacggagagcatatcatcagctcccctacagatgatcatcaaatactttggtaccaaacagacgaaggcgaattatttggagtagacaaatcaaagcttacagctagagaaacacatcttctcaatactttccttacaccaattgatctttctcacacaaagcggactgaggatgaacaacaatggtacagctatctttttgataacaagccactaaccgttcagcaccccgtccgtgtatattattttaaaatgtcacatcaagcagaacaaaggcagcaaataaaagaggctgtggttcacagcctcgaacaaactcatttcatttggacaggcgctcatacagcgatgctgattcaaacaaacgctacatcagaaaatagtcaattagagctgctatatgatttgtctctagccattacaagtgactttttaacagactcattctttttacaaggacaacttcatttgccaaatgaacatttacagaagaaattgttaaatgaacagcagcttgtctttggtcatatgcagcgaggtaagcttaggtcagggatttccacattttatcaatgtctgccatcacttttgcgttatgatgaaaccgccctctctcatgctatttcagatgcttttaaagaggcggttcttgatcgggacgtttaccgtaccctcatgacttatatgcaatgtaacttaaatgcatctaaggcagcaaaagctttatatgttcacagaaacagccttcaatatcgaatcgataaatttattgagcgaacaggaatagatatacgacattttccagaagcatctgctgtttattttataatgaaccttctcgatatttcataacattccgtgacatgagcaacctgcccaaaaatgaaaatgagatgttgtgcacgttgtccatttacagacgcttccccattttatacactttatgtacaatataaagcgctttcaataaaaggatggggaggttatcatttatggctgaaatgatgctcaatcaaatttataaagtgtatgataacaaggtaacagcagtagacaactttaatctacatatagaagataaagaatttattgtgtttgttggtccatctggatgcggaaaatcaacaacccttcgcatgattgcaggacttgaagagatttcacaaggggattttcttttagacggcaaacggatgaacgatgtagcaccaaaagaccgagatatcgcaatggttttccaaaactatgcattataccctcatatgaatgtatacgataatatggcttttggattaaagctgcggaagttcccgaaagcagaaattgatgagcgggttcgaaatgccgctaaaatattaggccttgagcaatatttagacaggaaaccaaaagcactgtctggcggtcaaaggcagcgtgttgcacttgggagagcaattgtgcgtgatgcaaaggtctttcttttggatgagccgctttctaatttagatgcaaaacttcgcgttcaaatgcgtgctgaaatatctaagcttcatcagcgtctgcaaacgacatttatctatgtcacacatgaccagactgaagctatgacaatggctactcgtcttgttgtaatgaaagatggctttattcagcaggttggagcgccgaaggatgtatatgaaaatccagaaaatgtatttgtgggtggattcattggctctcctgcgatgaatttttttacaggaaagctctctgacggtgccattgcagttggaaaaacgcatatacgtgtaccagaaggaaagatgaaggtattacggagccaaggttatataggaaaaaatatcatccttgggatcagaccagaagattttcatgatgaacccgtgtttatagaagcgtctgagggtacaaagatcgatgcccacgtagaagttgctgaattaatgggagcagaaacgatgctttactcttctctcgatggtcagtcttttattgcacgtgttgattctcgtaccgatgttcaggccggacaaactatacctcttgccatcgatatgaataaagcccacttctttgactcagatacggagctccgcattcgttccgctgaataaatatatatgcagtgccatcactcaatcatgagtgatggcttttttgcatgttgaacaacatttaccatgttcttttctcgtatgtttttttcgaaaatcaccataatacttagtacaaagcagttaccgcattgggtttcgccaagtggcaaatgacttgatcatttcgctggtgcgattccagcaaacccaaccataaaaaaatcacatacaaaaaggagattcacatcatggctaattctaatagttcaaatcaattactagttcctggagcagagcaagcaatcgatcaaatgaaatacgaaatcgcttctgaatttggcgttaaccttggagcagaaaccacagctcgtgctaacggttcagttggtggagaaatcacaaaacgtcttgtgtcttacgctcaacaacacatgggtggaacaaaagcttaatttcatatctggatcatagaaggcacctcttaaggtgtcttctttttttgttgttatccctcaccaatctcctttccagctcatatcatggagtagaaaggagcggatcttcatggacattatttccggtatgaactttgaacttctacaattcgtcggtatctctctattatgtgaatatgctcatagtattcggtcctttcatctttataaaaaaagcatcacataaaagttgtaccattttgggttcttttcacttatagtatgtagtggagggatcgaatagatgaaaatagctcttttcggtgctcatggacgtgtaggacaagcatttcttcgtttcgttcaagtagatgatcgttacatcgttcgttcattgattcggacaaaccgagaagaaatgcttgcgggtatgtttcaagtcaccggcaattcaagaaatctagaagatgtgcttgagacgatcaaaggagcagatattgttgtgagctgtctatccacagatggtgatgatacattatctgtttcaatggagcatatcgtacaagccatgaagcaatcaaatacatcaagaattattacaataggtacggcaggtattttaaaggcaaggcagcagccggagcattaccgttttgaaacaaatgaatcaaggcggaccacttcccgagcagctaaagagcatgccaaagcgtttgaactccttcaatcgactgatttagattggaccattatttgtccaacctatttaccagacggagaagtgacacggtcatatcgctatgagaaagattttctccctatagatggaaagaaaatttcagttgaagataccgcacactttttatatcagcagttaaattcgaaggaatttgtacatcaacgtgtcggtattgcttactaatgacgcataatgagtaaagatcgaggtcaaaaacgatcgctcgacttttttatgcaaataaaaagagcccattcaatatgaataggctctttttgtgattcatcagctgtttgccacagcacccttttgcagttcgtacatttgcgcatatagcccttcttgctgcatgagttgatcatgactgccccgctcgacaatttcccctttttctaaaaccaaaatcatatcggctttcttaatggtggataatcggtgagcaatgacaaaagtggttcgtccttctttgacgacatcaagcgctcgctgaatgatcgcttctgtttctgtatcaatgtttgcggtggcttcatctaaaattaagatcgctggattgtatgctagtgcacgagcaaatgaaatgagctgacgttcccctgaggaaagagtacttcccttttcaacgactggttcatcaaatccttctggcaggtgcttcaataactctactgcgcctacttgttttaatgatgattcaatcgtttctcttttaatgtcttcatttcctaagctgacattggatgcaatcgttccggaaaataaatacgggtcttgaagcacaatgcccatttgtttccgcaacgtttgccgggactggcgataaatgctttccccatcaatgagaatgtctccttgctgaatgtcataaaaacgcagcagcaagttcataatcgagcttttcccagaaccagtatgccccacaagtgcaatcgtctggccttttttggcctcgaatgtaatgttctttaatacattttttccttcattataagcaaaggtgacgtcttggaactgaacgtgcccttccatttccttctgaacaggttcttccactgttgttcctggctcatctaataatcggaaaaccctttccgatgaaacccgtgctaattccaatctcgagaattggttcacaatgcctgtaatcggctgaaataatcgatttaggtaatcgacaaacgcatagagcacaccaatcgacacaattcccgtcgcacttaaagaggcaccgccaaaataccaaatgagtgccacgtaggctaaattccgaagcaggttaaccaagttatgcgacagaagtgaatttaaatgaagcatctttcgctgatatcgaaagtgattgttgttcagctcatcgaattcctcttttgtcactttttcatgacgaaacgcttgaataatggtcatcccttgaatggcttcatttagcttggcattgatgtcactaatgatcgaacgaatgcggtggttgtataccgatgcaaattttctgtaggtcattgaccataggaaaataatcggtaccgccaccaaacaaataagtgccagcttcacatttaataaaaacatggcaatataaatcccaatcatataaatcgcactcgtcacaaaattggcgaggactgtcacatataaatcacgaatggtttcagtgtcattggtaatcctcgctacaacctttccagccggtaaattatcaaaataccggataggcagcgtttgaatatgttcaaacacatctactctcattttttgaataattcggttggctattcgctgtaacaggtaatgctgcgcatattgaaagaaaatcgcaatgacgagaagccctagataaaatagaacaagctgcaccaaaccactgatttccggctcataaaaagagaaaatttcctcttttgataaaggctgtacttgataggtctcgcgctcgtttccattttcaatggtaagttgatctcccgatatttttcggtttccgtcaaagcgaatcgtatcatttacaaaatagtaaccgaagccgacttgcaccacattgatttgttttccggattccatctcactgtctaatcgatcgcttcgtatatagttatttccctggtaataaacggttttgtctgttttttcattgacctcgacatatggcttttctacacctaaaatatgatcatcaatcattttcttcccaataaatggtcctgtcagttcagcacctactgcaatgatgagaaagatcaaggcaacagacagtacttttttataaaggagtgcgtaggcgaggagtcttcttcccgttgtcatgcctcatcccctccttccagctggtttgtcagctgttgacgcagaaattgttctttgtaccacccatcttgctgaatgagctcttcgtgagttcccttttggacgatgcgtccttcttccatgacaagtataagatctgcatgctcaacagctgatagacgatgagtcgtaataaacgtcgttttcccatgacgattttgccttaaattttctaaaatagcggtttctgtttttgcatctaccgcagaaagcgagtcatccagtattaaaatgtcgggatctattaataaagcgcgcgcaatggaaattctctgcttttgtccacctgacagcgccacacctttttctccgaccatcgtttcgagaccctctggcaaaagacgtaaatctttttcaaaataagcatctttgattgcttgtgctaattcattttgttttgcgtctcgatgaccaaaacgcatattctcttctacactttttgaaaagagaatatgatcctgcggcacgtatccaatccattgaaatagctgatccaattcgatctcttggattgggattcctgatagcaggatgtgaccatcacctgttggatactggcgcagaagctgttttacaatagttgttttaccgcttcctgttttgcctgtaattccgatcgtctgcccctttcgaaccgtaaaggacacatcaattaaattatcttttggggaagttggatacctaaatgtcacgtggtcaaactgaatatcgccaggctcttgtaacgtttttggctgagaagcatctgtaacatccggcttatagctgagtgtatgattcaaccggtctaacgacgcatttcctctttgcataatattaatcaactcgccgatcgcaaacattggccagatcatcatcccaagatatacgttaaaagcgacaagctcaccaatggttaaatcgctttggaatacaaggtaggcaccgtatccaattcctattaagtagctgaccccgacaagtaatttcactgtcggctcaaacaatgaatcaatgaccgctactctcatatttttttgaaatacatcatctgtcatttggcgaaagcgttcgacatcttgtttctcctgtacaaaagaccggatgacccggacacctgcgaccgattcaaggacgcgatcattcatatcaccaaatgcatcttgagcaactgtaaagcgatcatgaattttgctgccataatacgcaatcaagagcgccatcagcggcataggaatgatcgccattaaagttaatttccagctaatcgtcagacccatcgtaaaaaagatcatcagcatataagcagtggaatccaccaatgtcagaacgccaaaacctgtcgttaaagctacagcattcaaatcgtttgtacctaatgccattaagttaccggtttttttcttttcataaaaggtgggtgtcatcttgagtaagtgacgcataagtttcccgcgcatcacacgttccatgacatttgcgccgccaaataactgatacatccagaaatatgtcagtgtatagacaacgacacctagcaagcaaaaaatggctacataaaacatcatactagatgttgtaaattgaccagaacgaatgtcatcaactgcctgcccaagatatcttggcggcagcatttcaagcacattcacaatgagcaggagcgtaatggcgatcgtataacgcctccactcttgtttgaagaaccagcctaatttcgtaaatactgaaaacatgtttgtctctccttttaaagctagccgctttctatattttcttggctgtcaccttgaattgtttttttgttttttgtcatttgtcttgtttttggcatgttcacatgctttcactcctcttcatttacttgttgatctccatcccttatttcgaaatacgaaatgaatacaacaaaaaaagaggcaaccagctatctggtacgcctcttttcgtcatgtaaaaaggcgcatgttgacaaatacgcaacatacgccttgattcatccgatcaattggaacatacgagtcccttttcaatgaccaatgaaggtgtaattgtcacgtgaatcaacccattcatgcagtttgatttcattcttccaatgatgttgcacatgacatttcctccttttggctcttgaatctttttttatcttatagtggctgtcaccattttgtcaataaatatttttcaataaatgaaattttctaacaaaaagttcacaccctttatgtgtatctttttcagttaacgggtataccatgagtgtaaagactccttttgaaaggaatgaggacattgtttcaagctgatcggatggtcgttgcgtttgatggacatgaagacagtaagaaagcattaaaaaaggcaatcgctttagcgaaaaccttgcaggccaagctgaccgttgcctatgcatatgatggcaaatcaagcagacaggtgtttgatgcacctcgcccaatgactggcggtgcttacatcggcggcggcatggcagaccttcaaacgccccctgtgtatgtacctcatgatgaacagcaaagtcccttgatttttgaagaccatacagaagaggtcgttgcagaagcaagaatgcttttaaatgaggagcagtttgaggctgccattgaaattgttgagggagaaccagcagaagcgattatcgaatatgctgaagacatttcagcagacctcattgtcatgggagcccgtgaccaaagcagattgaaaaagatgctctttggcagtgtaagtgaaaaattatcatcaaaatcagatatacctgtgcttattgtcaaataaaagaattacaaaaggctgtaaacattcgtttacagcctctttttattatgaagaaatcgatgcttcactttcctgtttaattttttgctgaaagccttcctgtacacgctttgtcaactctcctggaacgccttcccctactggctggccatcaatttcaacaatcggaatgacttcagccgtcgtcgagctgatgaaaatttcctgcgcgcgcagcagctcttccttacttatacgcgtttcttcaacactgcatccctcttcttcacatacttcaagaagctttctacgggtaataccgtttagaataaaattgtttgcgggatgtgtgcgaatcacgccatcaatgacggcatatacattcgaggaggtaccctctgtcacaaaaccatccctaatgagaatggcttcaaacgcaccagcttcagatgctttctgtttttccatgacgttatataagagatttaagcttttaatatcacatcttaaccagcgaaggtcctcagatattatggcctttgcaccagctgtctgctcttgaacaggccttttcacttggaacgtatatgctgtgatttgaggagtgagagaatcgccatattgatgtttacgaggtgcgatgccccgcgtgacttgaatatacacaccaccatctgttaattggttatgggcgacgagctgttttaacttttcttccatatctgatactgcaccttgaagatgaatgccgatttcttttgcactcttgaacagacgctctgtatgctctttcaatgtaaacaaagtcccattgtatacacggataacctcatagacaccgtctccaaattgataacctctgtcttcaatatccacatgagcatcctttttttcaatgaaatcgtcattatacaatactttcatacggaatctccccttcgcttcgcattaatggttgaatctgatgctatcttagcggataaatgggtatgtttcaatgattattcagaattatttcacatcatgataaatggtcaactttctattgtaacaaagatagactcataaccaaaaagattccaattttttagcatcttctatattcataggctcttttttcctgtatacttactccatataaacacgacaaaaaacagtgaaaaaagacagaatctactacatgattcgacacaaatttttgatttattggagcgattgtaatgcaacgggttacgaaaaaacagacaccttcaaacacgatgctgctctcaaaggcgattggtttagtgattctgtcactgatcctcttttttatttgggatatatctaaaaccaatatgcaggcagcagaccagccgactaaaatgtctgcaagcagtcaattccgagacacaagcacaagtctgaaagcaaaagatgattctacgaaaacattagatgcacattttaagatcaacccaaacaaacacgtaacggatcaaacgatctttttaacctttgatgatggtccgtcagcgacatcaaaccagcttttagatgtgctcaaggcgcatcaagtaaaggctacattcttcatgcttgggccgcagattaaggaacatccggccgctgtgaaaagacttcatcaagaaggtcatcagttagggcttcatgggatcacacacgatgtgaaacgcttttatcaaaaaagtgattctcccatcaatgagatgaaagaagatcagcgcattttggcttctgtcacaggagagtatacacaccttgtgagaacaccttatggcagcgccccaaatttaaccgatcaacaaaaagcacgtttaaaacaaaaaggctttatctactgggattggacaattgacagtcttgactggaaatataaaagctcaaaatatgtaccagaagtattgaatcagctgcaagtgctagagacaaaacatccaaaggaaccaaagatcatcttaatgcacgaccagccagcgacagcaaaatacttaaacagtttgctcacacagctaaaagcgaagggctatacttttgaagttcttgatgaaacaatgacgccgctgcagcaataaagagaacccgcacctattagatgcgggttttttgatgatttatatagctttcacgagatcaccaattcgctcatgaaagacaagatcaaacagtggatcgtattctgtttcactcaaattcatcatcaccttgaagatggaaggattttgagcggcatcttctggaatatatcttgctggcgctacttctagggaggttcccatgacgagcagaaggtccgcttgctgaagtgatttctctacttgatcaaaatgtttaaccctgtctccaaaaaggacaacatctgttttcagcacttgcccacatgtccgtccgtctgaggaaacctttagacatacaggcacttcttcttgtaataaataaggcagttcatatgtcgcttggcatgatgggcaagtagctgtttgaatagagccgtgaagttcatatacatgctggcttcctgcttttttatgcagaccatcaatattttgggtaaaaatctctacatgttttccttgtttctcaaggctggctaaaaaggtatgcccgctattcggctcgtacttcccgctcattttcatctgaaacaattccttgaatttcggccagaattgatgagggtttgataaaaagtaggaccggctcatcgcttccatgcgagcggtgtcttcagtccataagccgcccgttgatctaaaatcgggaatacctgattccgtgctcatgcccgcacctgaaagtaccattatatgtgaagcctgcgttaatttctctcttagcactgccacctttgtttgatccactcatccttcctcctttattcactcagctgtttttcacctttttgtttcatgtaaatggtctgtccagggaaggcaaattctacaccttcttcatggaagatatccatgatccggtagttaatgtcctgtttgatatttaggttttcagcccaggccgtcgtgtttgtgtaaaagttgaaaaataaattcaaataactgtctgccagtacatcgagattcaccatgattgtctccttgtgcaccccatcatgctcataaagcatttgtttgagtcgtttgatacaatggtccagattttcctttggtgtattgtaggatacacgtacggaaaacgttatttggcgtttattcattctcgtccagttcgtgattggttcctttgaaagcgtagaattcggaactgtcacgactgcttcagcaggtgttctaaattttgtacttcgaaatgtaatgtcctcgacagtccccagaacacttggcgtctccacaaagtcgcccattgtaaaaggcttctctgtaatgatgacgattcctccaaaaaagttcgccaccgtatcctgtgcagcaagcgcaaaggctagcccccctagaccaagaccagccacaagtccatttacatcataattaaattcctgtgcaatcacactaatacttagtgcaatgataatgaaacgaagcaccttcgataaaaatggcgctaaaatatcatccatttctaattcaaatttcgaatttactttttgaaataagaaagaagaagctgcggttaaattacaaagcccccatgtcagcatcaatataatagaggatctatataatttgacgatgacatccatatgatgctcaaagtatggtgcctgtcttaacgcaaaatataacccaagtgcgacaaaaaacagtctggctggcttttcgaatgccacaacaatttggttaatgacctccgttttagaccgattggtcagcctaaagagaagatgaaataagtacttcgtaaatactttccgaagcaataaaaaaagcaataaaatacaaaggctaatgccgatttggatcgcaacatctactgtaaaatatgtatccatccatttttgtgtaaacatgtttgtctctctcctttaaaacaatcctctctagtttataatataaccttcgtttatgtcctctcataaatgtctgacctctaaataaaaagcctcgggaccagtcccgaggcatgatgttcaattatgaaattttggctagagacatatcgacgggcagcaaactactttttcttctgagcctgatcaaggagagtcgctttaaacatttcagcatccgtttcgaccttaatacgttcttccactctaattctccctttacccaatcatctcgcctccttttcatcattataaaacatcagaattttcagtcaacatgacgaaagcactaatattttggcgaacgctgacgatttggacaaaattgatcgaagaaaaaattgatgtacttcagatttactcaatcatggcttgggatattcctgtaacttttcatatttgaaacctcatactttctcggcacatgccgttcacccttacatactgctcttcttccctccatatagtaaagaaggaaaaacgggaaagcatttgatatgataagaccagaacttacgtcagggagctggagcatatgtatattatcgcgcatagagggtcatcaagcgctgccccagaaaatacaatcgctgcgtttgatttagctgttcagcagggtgcagattatattgaattagatgtacagctcacaatggaccagcacgtcgtcgtgatccatgatgatacagttgaccgaacgacgaacggaaacggcttcgtcaaaagctatacacttgatcagctgaaaaaactggacgcaggaagctggtttgaccaacagtacacgaatgaacgaattccgacattacaagaaattcttgaaagatacagtcagcggattgggatattgatcgagatcaaacatccaaaacggcagataggaattgaaaaggcagttgccgacatcatcaatcgttttgcctattctcgtcacatcatgattcaatcttttgatgatcatgcactgcaaagaatcaaagcattcgccccttctcttcgaacagctttgattataaagcctaatgcatttaaactgacgaaaagaaagttaacggcatacagctcgtttgcaaattgtcttaatatgaagaaaacgatgatcaataaatggtggatagaccgcatccacgcattcgggatggatgtgtttatatggactgtgaaagatcaaaaaacagctgatcggatcaaaaaatatcccgttgatggtgtcgtgacggatcacccgccattttttctaaaggagaaatgatgtaaatgaaagcatatcttgccgtatttattggcggactgattgggacactttgcagatatgaactgagccaaactgttgtcagccaaacattcccctatgcaacgctaattgaaaacgtgacaggcagtctgcttcttggtttttcaacaggatattttatgttccataagagaaaaaaatatcttgccgctttgatcggaacaggattttgcggaggttttacgacaatgtccactttttcaaaagaaacgattcttttattacagactgggcagttcacttcaagtgtgatctacaccctgctctcagtcattgccggagtagccgctgccttatgtggactaatgttagctcagcggctctttcatcaaaataagcagcagagaggaggcagataaatgatcattttatatacagctattgccggcgggatcggcagcgcccttcgttttttcattagccaaacgatacagaaatctaagtctcatgctcgtttcccatacagtattattctcatcaacttattaggtgctgccggtttaggtatactgacaggtgccgtgactgccaatcatccgctgcttatgatcattggaacaggttttttcggtggctttacaacattctctacatttagtgtagaatctgcaaccatgctagagcagcggcaaatcggaaaacttgctgtctacttattgatgacaatcatcgggtctttctgtctcttttctgcgttctatcaaataagacaacaccttttttaaatattggtaatagcggctaagctgataagcagttgatccataagctggcgcttcattaaaaagagggttttttcactgtagccgatttccatcgcacacttggccatacgccaatcacgaaagtatttgtaatcgatgagctgcttctctatctcatccaactcttttagtgctgtatcaacacacgcaacgatgagttcatactgatttttttgctcttctaacttcttccgtgtcatgtgatccaaatgatgcgtacttcttttttcaagctgtctttcgatatttaaaatcgccgcctggtaatttttgaagttcttcaaatgaaactcaattcgtttcattgagttttttttctccgtgatacttgctgtttcataccaaagcatgttcatccccctcatatcgaacgtttgttctcattataacccgaacaagtattcgtaaaaagagactaaatacccaaaaaaaccttgagcttatttttcgctcaaggtcatttcgtttactaacagcggctcttttatatcacgccctatgcgtgcatttcctttttctgatgaggtgacgcctttcttcaggtcgatctttttcacatagcgtccatccatctccaagaccttcatccgaatatcatcaagataaatggattgtccttctcggatatcaatattctcatttaagattaacccgcctattgtatcaatttcttcatcatgatatgacattccgatcaaatcttgaatttcatctaatctgactttgccatctaaaacataatgatgatcggctcttttttgaataaccggctgctcatcttcatcgaactcatctcgaatatcgccaacaatctcttctaatatatcttctgttgtaacaagtccagacgttccaccatattcgtcggttaaaatcgccatatgcattcgatcgcgctgcattttgacgagaagctcctgaataggaatcgtgtcaatgacctcaatcactggatatatataatcttgaatcttcaattgatccttttctacttgatacacaagatctgcaaagagctgctttttgttcagcatgccgatgacatggtctttatcgcctgaaaacacaggaaagcgtgtatacttctcctgcgtcatgatggagagaatctcatctagcggcatatcttctggaatggcacaaatttctctccgcgggaccatgatctctctggcaattcgattatcaaagtcgaaaattttgttcatataattatattctgatgggttgatttccccattttttaagctctcagataataaaatctttaattcttcctcagaatgggaatgttctttttcagaccccatatcgatgcccatcattttggttagaacccgagctgacccgtttaacacataaatgaaagggaacattaggatataaaatgcatgcagcgggcctgacagccagagcgtcattttttccgccttttgaatcgccaatgtttttggtgcaagctcaccgacgactacatgcaaaaaggtaataatagagaacgcaagtgttgctgagatcaggctgattgctgaatcaggaatgtttgtcaaaccgaaacctcgaaccaaaagttcttttacagctggcttaccaatccaccctaaaccaagggatgtcactgtaataccgagctgacaggctgacaaatattcatccagccttgatgtcacctttttcgccacgatggcctttttggacccttcggcaacaagctgatcaattcttgagcttctcacctttactatggcaaattcagatgcaacaaagaaagctgttaaagcaatcaaaacaccgactatactcagattaacaatatcgtccatttaaccttgctctttctcagaagaacaaggagtcacctcctgattgatgatgttatgttttgcaaaacggttaactgattaaataagactatattgagggccccacttaaccacctccggttcacgtataaatccgcttctctacatatatatgaaacggtcttcattttatcttaccataaataatctgaaaattcctgtatcactatgtgaaatttgacaggaccatttagactgagaaatccctctctcctcttcatatcggcaagaaatatgaacaattaacttgtatttcagactagaattatattaaactattttcataaactataacgtgacggttaggaggagatgttcagatggggctgagaaaaagtatcgtattggtgaactagcacagattgcacaggtgacgaaacgtactgtagattattatacaaatctagggttgcttgcgcctgttagatcttgctcaaattatcgttattacgatgaacatgctttaaaacgattacaattaatcgttctttgcaaacagcagagattggctctttctgacatcaaatccagattagatgaacaattcccttctcaaaaggaagatcctgatgaacttgtccatttaacctctgatatcgatcggatgaacgaatatatggaccgcattttagtacgttgtaagcagcttcaaccagaacaacgtgaaaaattaaaagagcagcttacacctgaaaagatgacggctgtccaatcatttttactgctgttaagttaaaatttttactatacaggaggtgttaccttcgttctcaaagtcagaacgaaggccttaattggacatagttaatttacttatagttgctttgcttatagctttaaccgcatttttcgttgcatcagagtttgcgatcattcgcttaagaagctcaagaattgatcagttaatcgcagaaggtaataaaacagcagttgctgtcaagcatgtcacgactcaccttgatgagtatctgtcagcctgtcagctcggtattaccattaccgcccttggtattggttggttaggggaagaaacaattgcgcacatgcttgctccactatttgtagagctgtccattcctcaatcagctagttctattgtcacttttattattgcgtttagtattatgacgtttttacacgttgtggttggagaacttgcaccaaaaacactcgccattcaaaaggcagagcaagtatctcttctttttgctagacccctcatgattttttacaaagtgatgttcccgtttatctgggtattaaatggatctgctcgtttgttaacaaaagcgttcggtcttcagcaagtttctgagcatgacatggcgcactctgaagaagaattgcggattattttatcagagagctataaaagcggcgaaattaaccagtctgaattcaaatatgtaaataaaatttttgaatttgatgaccgtctggcgaaagaaattatgattcctcgtaccgaagttgtcagcttccctcatgatattaccattgaggaaatgctgaaggtgaccaaggtagagaaatatacacgttatccaattgaagatggcgataaagataatatgattggtgttctgaacattaaagaggttctcactgcctgcattagcggtgagtgttctacaagtgatacaatcgaaaagtttgtcaatccaattattcatgtaattgaaaccgttcctgtacatgatctattgctcaaaatgcagcgcgaacgtgtacacatggcgattttatcagatgaatacggcggtacagctggtcttgtgactgtagaagacatccttgaagaaatcgtcggtgaaattcgtgatgaattcgatatggatgaaatcaacgaagtgcgtaaacttggagaagaccattacatctttgatggaaaggtcctagttgatcaagtcaacctgctcttaggtacgcagcttgataacgaagaagtcgatacgatcggcggctggttccttactcagaaatatgaagttgagaaaaatgacaccattcgtgaacaaggctatgaatttatcattaatgaagtcgatggacaccatgtggtatatatcgaagtcaaaaagttaaatgaacaattagcagaagccgctgaagaaggcgcttcttaagaaaaaaacgacccttgccaaagcaagcggtcgtttttcttatcctttttccattaattgagcttcaagttctttaattctcgtgtttaatacttcagtcatggcacctaaacgttcttttggcggcagatgctcaaattctgactgctcaatcggttcaccaataattaagcgcattttcccctttttgaaaagacttttcgcattggacggccctttgtacgctgctggaacgattggcgctttaccgagctgcgcaatggtaaccgcacctctttttaaaggtacatcctctgttgtacgtgttccgcttggaaaaatcccaacgatctttccctcttttaataatttaatgggcgttttaatactgcttggcccaggattctctcgatcaactggaaaggcatgaatcttctttaaaaatccaccgatccatttgtttgcaaacaattcttttttcgccatgtagtggatctcaaacggaagaatccctgcgcctaatgcaagaacatccacaaaaccctcatgtgtacatgcaatgacaaatccccgatctgttggcagattctctttttgatatactttgattccgcctcggagagtaaataatactttaatggtatagcctgaaaatttatacataatgcacttcctttgtttgaaaaatgaaggatttgtttctattataacaaattttttattacctggtactaatttttttgaaacaatcaaaccatcacatcatttttcgttcagaatcatcgttctttctgtattcaggtctatggttttaggagagaatagaagaagaattgtgtccaattttgtcgttttttaaggttttttcctgatttgttctattgaaaatgctttataaatggcgcaaatttcgctatgataaggagaaatgattttgattcggcgaaagagatgagtattgtacggtattgagaagtttcgtgcaactttatgcctttcttatgcgtttataacatagaggggagaaaaatcagtgacgatcgatgaaatttatcaaatgtatatgaacgatgtttacaggtttctgctctccatgacaaaagacaaacatttggcagaagacttattgcaggaaacctttatgcgtgcttatatacatattcattcctacgaccatagcaaagtgaaaccttggttatttcaggtggcacgaaatgcttttattgattatgtcaggaaacataaaaaagaagtgaccatatcggatgatcttattggcggccttttacaaacgtctgtacaaagccctgctgaacaggttgaaataaaagaagtcctcaacatgtatttggaacagcttccagataactacaaggaagcgttgacattgtattatttaaaagaactgaattacaaggaagcatccaaggtcatgaatattactgaagcaaattttaaaagtgttttatttcgtgcaaggcagcgcctaaaagcactatataacagaggtgttaatgatgaatgaagagtttaacaagcgatgggaacaatataataatggtgagatgaacgaggaagaaatgatggcgtttgaagaagagcttgaagaaaacgaaaaacgcttaagtcaggaactgaacgactcggattggaccgatttttccatcagtcctgaaaagcaaaaagccatcttgcaatacggaaaaagaaagtcttatttacgtatttctgtacttgctgtcatctctacacttattattttaccgctttgtacattaggaagttatctatattacggcgttggcggagcagagagcaaagggaatcatttcatggaaacagccgctgtaacagtcgctttgacgaaaccaaacgtggcaattgaaatgaaagatttaaaaggccaagtcaagctttttggaatgaacacagaactgaagctgcaaaaacaaattggcaataaaacagaagccattggcagtgagcaaatcgagatgttcttcgataaattaaagcagcctacgatctcatattatggtgacagcgcacgcgagacagaggatttctttacccatccttctactcaggcagatgcatcaaaaaaacaaacactcactactttagacaagcttcctgaaggaacagtcagtgaagtgtatgtctcctatgacaaagcgtatataccaaaggacgtttattcctttgctaaaaaatatgatatgaaagtgctctggaatgcgattaaaacagaggattcattaagcgggaatcagcggccaattggctttcctgggagagactctgaattcttaaaagagcttcagcacacatcaaaaacagaggtagatcaatttaaagatgcccttgcttatgtcaatcagcacccaacctgggcaaaaacgatctctggcagacctgaattggatctgtcaaaccgaatacgctatatcaaccaaaatggtgtcacgatttatggctctgtgatcacaggtccttcgaaagaaatcgagaaatttgtgaagacaaaacgcattaaaacggcaaaagtgagcgaggtggaattatggaattggtaagaatttttaaagagcataatgtatttggctggatttctgtcggtacagcgatattatccctgctcatgctgaacctcgccattatcagtaatgtgacattttattcttttcagatgctcccttttgcaatggccgcagttccatttggcattattgaactgttcattaaaaaaggccgtacgggccctgggttcctcggtgtcgtactgaatatctttgtcattttatgtgtctatgccatcgtatcgatcgatgtcgatcttcaattaggcttttaagccgttctcaaaatgaaaagcccgtgttacttgactaatcccaagtaacacgggctttttctatcgatttattttcttcattctacagcgcaaataaaaaagactgcttcataagcagtcttttaaaataaattagttcacaaatgttttcgctccaaggtaaatcggcttccagtagcttgaattcatatcactgatcgtcacaccatcggaagcagcatgaataaacttgttgttcccaatgtagacacccatgtgagatggacccgatttatatgttgtaaagaacacaaaatcgccaacctttggagaagatacgcttttcattgatccccagaaaccttcagttgtttgtcttgaaatctttttttgcttgttaatgatataccacataaatccactgcaatcaaagccctttggtgtcgttccaccccatctatatggtgtgccattgtacgctttagcatccgcaacaagcttagacgtgtttaaagaagaaacagaaactgttttttctttaacaggtgttgtctttacttttttagacgtctttttgacctttagcttttgcccaattttgatcaggtttgttttgagtttatttaacgatttcagctcttttacagtcatgccgtactttttgccgattttcgataatgtatcacctttcacaactttatgagtggctgtcgctgacgccgcttttacttttgttgttgtttttgatgttttcgttgtttttttagcggcagtaccatttacttttaacgtttgtccaacatatatcgtgttagatttcagcttattgtctgatttaatcttgctcacgcttgtcttatattttttcgctagaacagaaagagagtcacctttttgaacttttactgattgtgctgaggcagctccggcaaataatgtcgtcccaagtagaactgcacttgcagctgtgatcaattgttttttcatttgttcctcctgtatgtatctatcgtgatccgaatttttatctacttactattataaggatcaaataccagaagaaatagtcttgacttcctacgacattatgcttattaattcggcaaaatttatttttttttagggttctttatatttcattttcattacacaatcatgacaaaataaatgcatcttgtcatggataaatgatacattcatttctctttttggctcattctatgtaaagtggacctttacaattttaaagggatttttacgatcctgtaaatgggaatccacaattctgctctaccattgtaaacgtaagagcgatacataaacaatgaggaggcaaaatgaatgagtgtgttgaaaagctcgaaaacgaaaatcgctgcagtggcggcagcatctgtgctatcgattggcattttttcaggaattgaatttggacaagcggacaaagcagaggctaaaaagaagcccaaaaatgacgtgcaaaatgtgatcgtgctgatcggggatggcatgggaacaccgtacctttcaacttaccgttcatttaagcacaacggagacctttcaaaacaaacagcgtttgacccttacctcactggcatgcacaaaacatatcctaatgattcgaaaagcaatatcactgattctgccgcagctggtacagctatggcaactggtaaaaaaacttacaacaatgcaatcagtgtaaataaaaagggcaaaaaattaaaaacagttctagaagaagcaaaacggaagggaaaatctacgggacttgtcgtgacctctgaattaacaaatgccactcctgctgcgtatgcggctcacgatgtatcgagaaaaaacacagcatccatcgctgatgatttcttcgatgaaaaaatcggtaaacagcatacagtcgatgtcatgcttggcggaggtctcgtcgattttgtccgaaaggatcgtgatttaacgaaggaatttaagcaagctggatatgattatgtcaccaataaagaggccttacaaaaaaacaaaaatcaaaaggtgttaggcatttttgcagatggcggtcttgataaagcgattgatcgtgataaaaagaccccttccctgcaagacatgacgtcctcagccattaaacagctgtctaaaaacaaaaatgggtttttccttatggttgaaggcagccaaattgactgggcaggccatgatcatgatattgtgagtgccatgagtgaaatgaaggattttgaaaaagcatttgaagaagcgattcgttttgcaaaaaaggataaaaatacgttagtcatcaccactgccgatcattcaactggcggactctcctttggggcagacggctcggacagctgggattataaaccggtaaaagcagcgaaaaagacccctgattttatcgcaaacaaaatcgtcagtggcatgactgttgaatcagcgcttaaacaatatatcgatcttgatttcacaaaagaagaaatggcctccattcaaaaggctgctgaaacaaaggatgctgttaaaattgatgatgcgattgaagaagtgatcaacgtgagatctcatacaggctggaccacatcaggtcatacgggtgatgaagtgccattctttgcgtatggcccaacaagccaaaagctaaaaggtctgatggaaaacaccgatcaagcaaaacacattttcaaactgctgaaaaaccaataaaatcggcaaaaaaagatgtctgctcagagacatcttttttgtttttttaggcgagatattttctatgaactccttttccatcatacgaaaacatgacttcttttccttcaagaatggattcgatatgcacacttcttccccatagctgatgcaaatatgggagtactttttctaagtatttcaaatctagttcaatgccttcataccaatgtttaatatagagttcattgttttttaaatagtcgccatccatcacggtcaaataaggaaaaccgccattgaccctcatgctgactagctgatcacgaacagccttccattctttatcgatgactttataatctctcccttgtttttgaaacaagtacaaatcttctctcatcacaaggtcttttgttaagtaatttcgaatgaaggaaatatctgattcaatctccctgacttcaaacattttgctgcggcctgatccttctgtcacccctgccttttttaattcttcacatgggttgtcatagcgctcttcgatatcttcaaaaatcttcaaacctaaatagtaaggattgatgcccgtttttgacggctgcaccacgccagcatttaatttggcaaactcaatcgattcacttgaatccaaatcaagctctcgcataatccgctgatgccaatacgatgcccagccttcattcataatctttgtttctagctgcggccaaaaatagagcatttcctccctcagcatcgtgaggacgtcacgctgccacggctctagctcccgggagtgcgcctcaataaagagtaaaatatctttttccggctttggcggaaatggcttggcgattttctttttctcacgtattttcggctcatccattccccacaaatcatcatacggcgtctgacgctttggtttgtcatcttcatattcttcttcatcgccgatattccagcttagttttgaacgtacaagagacggatcaatatgctcctgaagagccaatacggcgtctaaaaaggattcaacttcttttgttccatgaaggtgctcatattccttgatccgctctgccgctgctgacatactttctaccatgtctcgttttgtgttttgaaaacggcaattatttttgaagaagtcacagtgagccagtacatgagccacaattaatttattttgaacaagcgtgttgttatcaagtagaaaggcatagcaaggatttgaattgatgaccagctcataaattttgcttaatcctaaatcataatgaagcttcattttatgaaattgtttcccgaagctccagtggctgaatcgtgttggcattccatatgcaccgaacgtataaataatttccgcgggacagatttcatacctcatcggataaaaatctagaccaaatccttctgcaatttctgtaatttcatcaatggctctttgtaaaagacgtttttctgatacgctcaaggaaaccatccctcctcatcggacttatccctactatatgagcgcatctaaaaaaacatgatgttccgccattcgtttagacgacttccatttcttttgtggactgcccaccgaatgactcgaaatgtatattctgttctggaattcccagctcttttagtatataaatcatctcttgtgtaaataccggggaaccgcaaagataaaattgccccttcccttctccaaccactgattgaaggaatggacggtcaatgcgggaagctgccttttcaacaagctcacctttaccagactgcgcaaattgttcattacataagaggatgcgaccatgcggagctgaagctagaatgctttcaaattcatgttcaaaagcggtgacatcctctaatcgatctgcatgaatcattgtaaatggctggctgttttgcgctgctgttttcaataaaccaatcattggtgtgacgccagaacccgcactaatgaaataaacaggctcttttgtgtcttcttgcaagcagaacattccctgcggcatactcacttgaagaacgtctccttcttccatttcatcatgcaaaaatgtagacacatgaccatcgcgcttcactgtgatgcggtaataagatggatgatgctgatctgataagctgtattgtctgctgcacatataagcctcacccggcatatctgcctgaaccgtaatgtattggccggcatcaaacattggcagctctgattcatcttctggtactaaataaaaggagatcagtgctggagattcctgtacttttttcttaatcacaaacggtttcacatctgaccatccgcctgtttgttttacattctcctccatcatttctgcttcaatcgtaataaagatattcgcaatgatgtcatatgccgccttccaagctaaaagtgtgtcatctttttcagttaaaccaaacacttctttcatcgcttcaattaggtgatatccgacgattggatattgctcttttttgaccatcacactgacatgcttatgggcaatctgtttgaccgcaggaagtaattcttctaatcgatcgatatgcagtgcagcttggtatagtgttgcagcaagcgcctctggctgacttccgttcataaggtttgttttattgaattgattgagtagctctggatgctggcgaatcatattttgataaaaaacagtcacaagttgggttccctcggcttttaataaaggggctgattgtttaatggcattcatttgatctttagataacatcgttattccttctttcaaaagatgtattttaaatacatctttatcgtaatggatgacagcttataaaagcaatatttataatacatgttttaaatgttgtcacatttaacactttctcgaacagtttttgtctaaagtgtgttacgatgatacaaaactctatcaggtttagaggtcgtcaaaatgaaactaacgaattatacagatttctcattaagagtactcatttatttagcatcaagagagaacaatgaactgtcaaatattcagcagatcgccgatgtttatggcatctctaaaaatcatctgacaaaggtgatttaccatcttggaaaacgcgggtatgtagaaacaatacgtgggcgaaatggcgggattaggcttgggaaaagcccagaaagcattaacattggagaggttgtccgttatacagaggatgatttagtcatggttgaatgctttgatccaagcaaaaacaactgtatcatctccccgatttgttcattaaagcatgtacttcatgaagcacttactgcttacttgcgcgtacttgaccaatacacattaaaagatttaactcaaaacaaagatgctcttagagagctcctcctttaggcgaaagaattctattctttcgtctttttctttacctccttgtaataataattaatttaaaattattataaataaatattgactatcatgtttgattcaatataattagggtatatagattgctagaaaccatttttttgtttacaggaggagaaaaagaatgacaaattcaaatcataaaaatttgacaacgaaccaaggcgtacctgttggcgataaccaaaactcaagaacagctggtcaccgcggacctacatttcttgatgattaccatttgattgaaaaacttgcacacttcgatcgtgaacgtattccagagcgtgtcgttcatgcaagaggcgccggcgcttatggtgtgtttgaagttgaaaatagcatggagaaacatacaaaagctgcctttttaagtgaagaaggaaaacagacagatgtttttgttcgcttctcaaccgttattcatcctaaaggttcacctgaaacattgcgtgatccgcgcggctttgctgtcaaattttacacagaagaaggcaactatgatttagttggtaacaacttgccgatcttctttatacgtgatgcattgaaattccctgatatggttcactctctcaagccagatcctgtaaccaatattcaagatcctgaccgttattgggattttatgaccttaacacctgaatccactcatatgctcacatggctcttctctgatgaaggaattcctgcgagctacgctgaaatgcgcggttctggtgtgcatacatttagatgggtcaacaaatatggagaaacaaaatatgtgaaatatcactggagaccttcagaaggtattcgcaatttatcaatggaagaagcagcagaaatccaagcaaatgatttccagcatgcgacaagagacttatatgaccgcattgaaaatggcaactacccggcatgggacttatatgtgcagttgatgccgctgagcgattatgatgatcttgattatgatccttgtgatccaacaaagacatggagcgaagaagattacccgcttcaaaaagtaggacgcatgacactgaaccgcaatcctgagaacttctttgctgaaacagagcaatctgctttcacaccaagtgcacttgttccaggaattgaagcatctgaagataaactgcttcaaggccgtctgttctcatatccagatacgcagcgtcatcgtcttggtgccaactatatgcgtattccggtgaactgtccttatgcacctgtacacaataatcagcaggatggctttatgacaacgactcgtccaagcggtcatattaactatgaaccaaatcgttacgatgatcagccaaaagaaaatcctcactacaaagaaagcgaacaagttcttcacggtgatcgaatggtgagacaaaaaattgaaaaaccaaacgacttcaaacaagctggggaaaaatatcgaagctactcagaagaagagaaacaagcattgatcaaaaacctaacagctgacctgaaagacgtaaatgacaaaacaaaattacttgcgatctgcaacttctatcgtgcagatgaagattatggacaacgattagccgattcacttggcgtagatatccgctcatacctgcaaggaagcatgaaataatggcttaagaatgttgacaaagggctaaaatgatcttgattttagcccctttgtcttcttttcagcggaatagaaaaccttggcagccctaggaaggacgagtattggcgcacatttatgatgtgagcaccagcacacaggacaatgcaatggtttgtctccacgctggagcacctctttaatagaggtgctttttttatagccggaatacgttaatactaatcaaatgaccggtgaccgggtgaaaatagatttctgcatgtgcagcaaaaagcgttgagccttccttcactgtgacgcgaaagacatcttttgtctgatcttcatttacttgtgtacgcccgatatattgataatcgtttaaagcggcgccttcatattcctcttgcagcgctgtatacgcaagtctttcccaattttcaacaggctgcatcgctgcatttgttgcaggatggatcatgaaactgccaaacaaaaccattcccgctgcaaacggcacccaccatttcggctgcatgatatcattgatctcactttcatgtatattttgtttatgttttgctgatcgatccattttcatacatgaagcatttattcagcctataattcccggtacacgattgatgcggacaccaacttttcccctgaaaatgtcgatatgttccgagcaaactaatgaggacttctcaagggaaaggagaaggtttaatgaatgtggcggattatgataaagcactttattatacgcatcgctcgcagtgggataatttacttattcttatggtacgtacgcaagatgacttgctctcgaaacgtattgagcatttcttacacgcgtatcaatttaaccggaacgatgctgatgttgaaaaatgtttatatgggctcctgcagtacattgaccatgcttcagaggctgctgcttctgaagtttattcacaaccgatgtacacataaagaaaaaggctgatgatcagcctttttacatacaattagcagtgcgcagtaattggaagcataaagtggtctttgacccaatcttgttttgtataaacaaacagcgcatcctcatcatttggcgccttcaccgtgtgtaagccgtcaattgacgtatcaggtgtaaaatagaacatcacttttttcgtcgtttcattcataatatgtgcaacaacttcctctatattttgtggctcaagagaaatgatatcaaagacatgtatggtttcattttcttcattcatcaggacaatcgtatccaatgcttcaatatagaaaatggcctccggccaaaccaatgtaaagtagaacattaataagctgccatgatcctcagcatctaatttcattgaacccgtttgacgtttttctgcgaactgttcaagtaatggcaggtcatgttccaatgttagctgcttgaagcgcatgtccttatttatctgaatgacgcttttgccgatatcgagactaaattcactttcgtggtaacgggtaaagccgaatttcggatagtccagtacagtttcattggcaaaaagaaaaatcaaaccacagtcatgttcgtacgtatccataatatgctgcattaactttgtcgctaatcccttgttgcggtaggcttgatccgtcatcaccgtgccaatttgaacagctcgatacgtttcgccatcaatgatcagtgacatgagataaacggaagcgtttgagatctctttcccgtgatggacaaaggaataaggaatatatttttcatcccaatatcctcttttgtaccagtcactaaaatccaaatcaaaagttttgatcgctaattgattaaagctttctttcaattcgttatcatagcgataatcactcactaattcaatatgtgtccatgctcatttcctccttttatcatttcacctctagtcagccggtttatcaccaccttcaaaataaaaaaagacttgatgagcagatactcatcaagtcttttaacgtttatctcatagaaattagactgaacacgcttctcttatcacgcaaaagggcacgtcaaataaccaactactgtgctctttttattcaattcattgaactgaatgtgtgcttaaaagttttagcataacgactaaattcccttctgttatagcagctctttgggctgacttttttgataatccactgcatatagagccgcttgggtacgatctgccagctctagttttgataatacatgagatacgtgcgttttgacagtcttttcagaaatgaacaaagatgaggcaatttctttattgcttttcccctttgcaatttcgaataagacatctcgctctctattggtcagctctttcattaactcccatctttgctcttttggctcagtcaaatgctgcacaagaaaattggtgatatgaccatctaattgataggtgcccttttgtacgtcaatcattgtcgtaagaagtttttctggcgctacatccttgagctgataggcttttgcccctgcttgaatggcgggaataacataatctttatccgcatagcttgtcaggatcacaatgcgggtatcaggcatttccagcgtcatttgtttcgttgcctcaatgccattcactacaggcatcgataaatccatgagaacgatgtcagggcgggtttgtctgacaatttctaatgcttcttctccattagaagcctcaccaacgatttcaacgtcaggctgtgtctgcaggaaaaacacaagcccttttctcacaatatgatgatcatctgcaatgacgactctcatgacgaccccttcctttcttgagaaaatggcacctttacttgaatagtggttcctttaccgagctcagactctatacaaaatgtccctccagctcttttgatgcggtcagacatccctttcagaccgagtgaaggaaggctcatttgctcgtcatactgaaacccttttccgtggtcgatgattttcatctcaaacgtgtcttttgattgttcaagctggaccttaacttcctctacttccgcatgtttttgacaattattcagcgcttcctggcatactcgaaacaacgtttcatgctgggtatgatccatctccatacagcctgataacgataatgtacagcgtaatcctaaaagttttgcatattcttgaatccctgttgtgaatcctttttcaagtcctcttggccttagctgccaaatgagtgaccgcatttcaaccagtgcatcttgtgacaaatgctgaataaaatcaatcatttcccctaaattctgatcgtttgtcatttgacgggcggctttcgcagtcagactaactgaaaatagcatttggttaacggaatcatgcaagtcctgtgcaagccggtttctttcttccaaaagagcatgctgatgttcgttttgcacaagcttcatccgttgaatagccgtaccaatttgaagcgcaatgctttcaagcaagttcaattcttcttgcgtaaatgtgacttttccttttgccgccacattcaataatccaaacgtacgcttacatgctttgagggggaccgtcgcatgatgcgtaattccttcagtatccccgagctgctttttcatcgccgtttcgatgcgtttacaattcataatgtttgtggctgattggagtgagccttttgtgtatcgattgatgcaatagcaatcgttttggcacatgagctctttttgatgctttgccagcgcttcgggtaaggagacctctgccatcagttcatacgagccgtctttttctataaaataaatccatgctgagtgaaagcctgtgatatccatcagcatatgaagcacttcatgaagcgtttctttcatttccgtgccttcatttagcttttcagcaatttcttttaacgtttttaatgtctcaaccttctcttggtattctcccatactgtttacccccggcatttgctgccttctcttttcattacgcctcattatatcatgagcattctgccggttctttctctaaaaggatgattttttctcatccttttgatggagaaaaagccatcatgcattcacacgatggccttgtttgtttatttagctgtttcttccacgatttcataaacgactttcatcacttcttctgacaaatgcttcagctttttttcgctatctgttaacgatgtacctttgacagccatataaaatttcactttaggctcagtgccagaaggtcttaaacagaaccacgagccatcctcaagaaaatacttcagcacgtttgatgctggcagatgaatggtttcttctttcttttcggaaacgaggtgtctttgacttgattggtaatcctcgatgacagtgatgcgctgacccgcaatagcagctggcggatttgttctaaaggtatgaaggatcgctgaaatttgctctgctccttcttttccttttaaggttaacgactttaacccttcccggtaaaatccaaactccttgaaaatatcaacaagcgcatcgtacaaggacttgccttgttttttatagaaagcagcaacttcgacagctaacagcgctgcttgcaccgcatctttatctcgggcaaagtcgccgattaaatagccatagctttcttcgtatccgaattgaaatgtgtattctccgctctcttcgaattgcctgattttttctccgataaacttaaagccggtcagtgtgtctatcgtatgggcaccaaatgcggaagcaacagcacgcccgagctcacttgtgacaatcgttttcatcacaacaggacgaggcggcagctgaccaagcttttgtttttcagacaataaataatggagcaatatggctcctgtttggttgcctgttaagacggtaaactctccatcatgatctctgactgcaatacctaacctatccgcatctgggtctgttgcaatgagtatatcggcattctgcttttcgccaagcttgatggcatactcaaatgctgcatgctcttctgggtttggtgatgtcactgttgaaaattgcggatctggtctttcctgttcaggcacaacggttacatgctgatagcctaaagcttgaagtccttttcggacaggctggttggccgtaccatgaagcggtgtgaaaacgactttaacatcgacctcacctgccagctcagggtggacactgatcgtttttaatttttcaatataagcatgatcgatttctgctccgatcatcttgatcagccctttttgttttaacgtttcttctgaatcaactgaaatcgacagttcattttctattgcatctacttcttgaatgacttgatctgcctgaaatggtggcagctgtccgccgtcttctccatatactttatagccattatattctggtggattgtgacttgctgttacgacaatcccagcaaatgcattcagctctcgaacagcaaaggagagctctggtgttggacgcagttcgtcaaatacgtatgtttggatgccctgtgaagcaagagttttggcagcttccatcgcaaattcaggcgatttatggcgtgaatcatatgcaatggcgacgcctcttctttttgcatcctctccatgtttcgcaatatacgcagcaaggcctgcagatgctttacgaaccgtgtacacattcattcggttcgtgccagcaccaatctccccgcgcattcctccagtgccgaactcaaggtttttgtagaaacactcttcaagtgcttgttgatcatcttgatgtgcctccagccattcccttagctcagtatccaggtgcttctcattgatccatcgctcataattcgtcttccaactcatggtcgtcctcccagctcttatcatcaataaaataacctctactgttattttatatggaatcaacctttatgtcatgctatatcgttgggagatgaagaaaatgatgaacaaataaaaaaagccgatacatgatcggcttcagattgttgacaaagggctaaaatatacttgattttagcccttagcggcttttcttttattcagcatcaagcggtacaactgcttcatggaatagttgatctaattctgtttgatgcttctgtttgactgcttcatcccagccaaaacgctctgccatataatcaacgacaggctgtgcatatttttttgcccagttgatattaaataatagacttcctgttcttcttaagaagaaatcgacaggggtaacagctaattcttcttcgattgcatagacaagctctgcgagtacatacgctggaatgtttcgtttgtctgcttcaccttgaagctgctctacacgtttgaaaagactgctgacatttgagccatatttttcggcaagtttttgagcaactggttctgttaaacccacagatgctccttctgctgttttcgcttggacaaaggcagccatattttttgatccgcctacatgaccgcctgaaattggcatatgctttgttttacatgatccaaagtctttgcctgtttcttcttttagtccatcacgtacaagattcacaatgtgctcagccattttgcggtagcctgttaatttaccgccagcaatggtgattaagcctgaagatgatgtccacacttcatccttacgagaaatttctgaagggtctttgccctcttcatgaataagtggacgaagaccagcccagttagattctacatctttttctgtaatattgagatcagggaacatgtattgaatcgctttgatgacataatcacgatctgcttttgtcatacgcggatgttccagctgctttttgtacactgtatctgttgtaccaacgtacgttttgccttctcttggaatcgcaaagaccatccgtttatcaggtgtgtcaaagtagatcgcttgttttaatgggaagactgattggtcgaatactaagtgaatcccttttgtatgctgtaagtgcttcccttcttttgagtgatccttgtctcttagctgatcgacccacggacctgtcgcattgacgattttcttcgcatatacatcgtaggttttctgcgtcatgacatcttcaatgacaacaccgaccactttgcctttatcataaataaattcttttactttcgcatagttgaccgcttctgctccgaatttcacagcctctttcatgacttcgattgtaaggcgtgcatcgtctgtacggtattcaacatagtagcctccgccttttaaaccgtcctttttcacaagcggttcttttgcaagtgtttccttcgcacttagcatgcttctgcgttcactatgcttgacgccagctaaaaagtcatacactctaagcccaatggatgttgaaaacttaccgaatgtgccgcctttatgcatcggaagaagcatccattctggtgttgtcacatgaggaccattttcatatacaatggcacgctctttaccgacctctgcgaccattttcacttcaaattgttttaaataacgaagtccaccgtgcactagtttcgttgagcggctagacgtacctgctgcgaaatcctgcatttctgcaagaccgacacgcattcctcgtgaagccgcgtcaagtgctgtacccgcgcctgttatacccccaccaatgataaacacatcatatggtttttttgtcatttcctgcagcatttgttctctttctaagctagaaaaagtcatctcttgttcctcccatgttgtacggtaaagaaaaagagaccgcaaacacccaaagcgtatttctacacttcggtgcctgcggtctctccagttctccaaccgttctattaacttacttgaagtataccatacttttggtttatttgaaagcttgagctgcttttacagcctttttccacccgctgtataacgagtcacggctgtcttcttccatcttaggatcaaagcgcttgtcaaggttccattgttttgcaatgtctgaacggtcgttccagaagccaactgctattcccgcaagataggccgcaccgagtgccgtcgtttcattaatttctggacgctctacaggcacatccagtaaatcactttggaagcccattaagaaatcattctttacagctccgccatcaacacgcaatgtttttaatgaaatgtttgaatccttttccatcgcatctaacacatctttcgtttgataagcaagtgattctaacgttgcacggacaaagtgctctttagaagtaccgcgtgttaacccaaacacagcgcctctgacatcactatcccagtatggtgtgcctagaccaacgaatgccggaacgacgtatacgccatctgttgactcaacgcgctctgcataagcttcgctgtctttcgagtctttaaacattctgagtccatcacgcagccattgaatcgctgagccagcaacgaaaatacttccttctaaagcatattcaactttgccgtcaatgccccatgcaatcgtcgttaataaaccatgatccgacttaatggctttttcccctgtattcatcaacatgaaacatcctgtaccatatgtgttcttcgccattccttcttcaaagcaagcctgaccgaataaagcagcctgctgatctcccgccgctcctgcaatcggaatatttctgccaaagaagtgatagtctgttgtttcaccataaatgtgtgaggatggtttcacctctggaagcatagaagccggtacgccaaggatatcaagtaattcttcatcccatttcagatcgtaaatgttgaacattaatgttctggacgcattggagtaatctgtgacgtgtgatttaccgcctgtcatcttccaaatcagccaagtatcaattgtgccaaacagtaagtcgccattttctgctttctcacgggcaccttctacattgtctaagatccattttacctttgtacctgagaaataagcatcaatgagaagacctgttttatttctaaacgtttcattgtgtccttgttcttttaactcttcacaaatgccagacgtttgtcttgactgccaaacaatggcattgtaaataggtgcgcctgtatgtttatcccaaacaaccgctgtctcacgctggttcgtaattccgataccagcgatttggtctgcttcaattcctgattcaattaaagcagttgaaatgactgatagaacagagctccaaatttcatttgcattgtgttctacccagcctgggttcggaaagtattgattaaattccttctgagctgtatgtgcaattttgccttcttgatcaaataagatcgctcttgtgcttgttgtcccttgatctaatgcaagaatatatttttcttttgtcatgatgttttcctccccttacatactttcatttacagcatttgtttggtttttcgtagagacatagagtcctaacaataccacaactaaaataacgcttacaatccaaaaggctggagtgacgttcgctttaaaggctgcattgtagaaaacaccgccaaatgcaccgcctaaaattggaccaacgactggcacccaagcatacttccagttcgatgggccttttcctggaatcggcaagatcgcatgtgcgattctcggacctaaatcacgtgcagggttaattgcataaccagttgttccacctaaagaaagaccaattgcaacaattaagaaaccaacaatcagcggattgactccgtctgcaaatttatttgcaccaatcgctaagattcctagaaccaatacaaatgtaccgataacttcactaagtacgtttgcaaaagtatgcggaatcgcaggaccagttgaaaatacacctagttttgcacctggatcatctgttgctttccagtgcggtaagtaatgtaaaaagacaatagtagcccctattaatgcgccaagcatttgaccaacaatatacattggaacatcagcccaaggaaaacttccttctagcgcaagcccaattgtgagtgcagggtttaaatgagctccactaattccaccagttgcatatgctgcaatggctactgcgaatccccatccgaaagcgattacaatccagccggattgatatgcgagtgatttctttaaattaactgccgcacacacaccgcctccaaaaataatgagcagcattgtacctacgacttctccccaaaatggtgtcatgaaaaattcctcctctggttcagttgccatcccctatgaatgtgtagaaaagataaagaaaaagatccacaacaaacatactttacattagggtcatttgtcacctagtaaagcgttgttgtggatctccatttctccatcacatgatattaacttagtgctatagtatcagaggatgaaaacgttgtcaataaatattcacattttatctttttacttttggaacgctttccaaagggtggtatttgaggtcgtcacagctgtagcccctgcttcaagcgctctttctacatcttcttttgtacggataaatccgcctgcaaaaatcgggatcccagttcgctcgcgcacttctgtaattaaatctggcacgacgcccggcaatacttcaataaaatctggacgatgtttcccaacgaactctatgcttttttccatggcactcgtatcaagtaaaaacattcgctgaatggcatatacctttttttgcttggcttttactatgacagaagacctagtagaaataattcctgctggcttcatttcctgacaaataaattccgttccatactcatcatgtttaatcccgtgaatgagatcgacatggacaaacatttttttgtgatgagcatttgcctcattcatgatgcccttaagccggcctaagtgaacatcaagtaaaacaccatatgtaaatggactttttaaaaattcctcaaattgcttcatattgcgtacagcaggtaaaatgggttgatcatgaaaactcatagccgtctccttcaaaagtgtattggatcagtcttctcctaacagtaatagaaactcttctatttttcaatacacgtagtgtgcccaataccgctttcatctcacatcaccttcctagaactagctcaaaatgatgaaaagcaaacttttattccataaaaaaaagcagagaagtctctctgctatagctgtgccatgctttcttttaaggtattgatgataaatgaggcgtcatcatctgttatattaagcggcggtgcaagctgggcaacgttattatagccggccactgtatccccatttttcccgatgatcagcccgcgttttttacattcagcaatcaattggccgacgacatgtggttcagctggttttttggattgttgatcctgaacaagctcaatgccaaatagcaacccttttcctctgacatctccgacaaatgggtgttcttttaactcttgcaaacgttcaagcatatcccggccgagcgcatcggaccgttccactaattgctcgttttccataatctctaggttcgcaagtgccaccgcacaggaagcagggtgaccgccaaatgtattcacatggcgcagcctgtcatacgtatcttctcctgcataggcttcatagatttctcgtttcacgcacgttgcagaaagtggtaaataaccgcttgtgatcccttttgccatggtgataatatccggctttacttcctcatgcataaaaccaaaccgcttccctgtccggccaaatccgcagatgacttcatctacaatgagaagcgctccatgggcttcacagatatctttgaccttcttcaaatacccttttggcggcattaggatacctccgcccgtaatgatcggctccataatgaccccagctatcgtctcacttagttcccacgtcatggcctgatctattgccgcagcacttgccagattctcttgatcctcaggatgacgatacatatcaggcggtgcgacatgaataaagccctgacctaatggttcatatttatatttacgctgcgcttgaccggttgcggcaagagctgctgctgtattgccgtgatacgaccgataccgggagataaactttgtcctagtactctctcctttttgcgcatggtattgtttagccattttaaatgcagcttcgttggcttcagaaccgctgttagaaaagaagatgacataatctccgccaagccactcatttagcttttcagccagctgaatcgccggcacgtggctttgtgtaagcggatagtaaggcattgtctttaattgcttatacgccgcttctgcaagctctctccggccatatccggcatttacacaccaaaggcctgacattccgtctaaatagcgattcccatgaatatctgtcacccaagcaccttcagcctcgtgaatgaccatactttcattttccttgtttgtccctttcatatgatgccaaatcaactgatcatctttcgcctgaagattttgagcctgctcatgtattttcatcttcccgcccccatgtatccgttttcatcattaaagaagcttagaccagttcagcagcacattgccgctccattcattatatggatgaaacgtgaggcttatgaaactggcactagaacgcctgtaaaagagaaccaatcgttactttcattataagaaaggggtcaggccgattacattagacagatcgtcaactgattgaacaccatcataagacacttttcttaatgccttggcaaaatcgctaacgtttatttccttgcaggaattcatgagcaagaatcgcaaattcaagcgcctgtcgtttcggcgccttcatcatatcctcaccgagcaaggcatgcagtttatccagtctatgataaagagtttgcctgacaatataaagctggcttgcggtttcttttttagaaccgtttgtttgtaaaaagatattcagcgtttgatagagtctcccgctattttgattatcgtatacaatcacgggctctaaatactctttcaccatacattcaagcagaccgctttccttcatcataggcatgagacggagcatatgtagatcttggtaaaatgggctttccacccgctgaggcatcactttttttaaatgcagcaattctttggctgcttgaaagctttttctcatgtgctgaaatttttcacaatattgaccgataccaaaatagatctcggcccctcggggctgctcccgattatacaattgtttgatgtcgtttgcagccttttccgcacgctctttccagtcctctttctttctcgtgtttagtaaaataaacaaggtttgttcttgatgctcatatgcaatcagatggaaaccagcacgctgaaaaatggagcggcaagagacaagaaagtaaagattccctgcgatttcttcaatttgatgatgcttttgaaagagcaagacgacgcagccagttggctttttcaccccttctgtttcttcaaggtgctctataatctcttgttctgtatgctcttcttgaaaccatttttgcagccattcattttcttttgtctttttcagttcttctgtataaagctctcttaatgtttgctgggctagagcattcgctcctttatccatcacaagcagttcaaattcagagagcgtgtctgcttgatgaatgagcacaagatctgcaaatgtttgtttgagtgcaagcacttgtttttgtgtcacttcgtatccttttggcacggaagcaaactgcaaataattcatgaccagttcttccgtttgtttggaagaatcgcataaaataatcggctcgccctgaacagggaggagtaaaagaatcccccttacatgctgatacacttgatccaaaatatccatctgcggatgcggagtcagcaaaagctcatttagctttgatgacagtgcttctaaatcagccatcatttgatactgacgctcgatcatcatcgtatgaagatgctgcgtgatgttgacgaacttcacttcttttgtaaacagaataagcggaaaatctctctcttctgcataagtcagtaattcttccggcacttcgaatcttagcgggacaaattcaatacacaagccggccgcccctgaatcaatcaactgtcgtaaaaacgcttgaaacacatccggttgatcatggaagcctgcggctgttgttaatataagctcgccgccatttaataaatcctctacatcaggaacttctaacacatgtatccatttgacctgccgaaacaatcctttttcccctgctaacacttttgcatgcgcaaaatgcttcgttttcaacacgtcactcacttggaaatgaacatctacattcattcatatgtccccctttgtttgccgcctatcccctatcccagagggtgcatggataaaatccataataaaactggtaatgtcacgatacttaagattgtactgagaaatgtcgtgcttgagacaaactcaggcttcgttcgaaattgtacagccatcagcgtggtatttgctgctgtcggcatcgctgccactaaaatcataatttgtttcaccatatcatctactggtaaaataagcgtaaagccaaatgcgatgagtggggagataaacagcttcagcaatacagcataagaaatattgcgaaaatccacttgcttaaaagagatcacggcaagctgcatgcctaaaataagcataatcgtcggtatggccgcattccccacaagctgaatacccgtcatcagctctttaggtaatgaaaggtcaatcagctgaaataatagaccgatgagcgccccgtaagcaactggcatacgcagcacttttttcaagacgacctttccatctcctgcatcctctccgccctttgctgcataatacatgccgattgtactcatgacaagctgctgcagcaccatcaacacgatcgcaatatccaagcctgcggctccgaagacaagcagcacaacaggcgtgccatagtttccattgttcataaaggctgacgacagaatcatggcgcaatacgtttcattcgaatacccataaatacgagataaaataaagacacataaaataagtgcaagacaaagcccgacaacaaaaatggataaatacacatagtccatcgacactttgttttgataaaaggtttcaaacgcaagaaatggtgacattaaatataaagacattgatgagagcgtatgtatgtcaaaaccaatcgccttctgcccgatatacccgatcaggaatatgccgaacactggcagtaagacaagtaaaaactccatgctgcacctacttttctctagttgaattccagattccttctgctcctcattatcataccactgataaacaataaaaaagaagcacccttatgaaaggccgcttctttcctcatccatataaaacacttcccacaaatgaccatctagatcctgaaagctccatccgtacatgaactcatgatcctgcttctccttaaacggtgaaccgcctgccgccattgcctgctcgacaagctcatcgacctcttcccgtgaatgaacgcgcatagagattatcacctctgatgctttttttgcatccactaattgtttctctgaaatagattgaaaatgtctaagagataacagcatgacagtgatcgtgtcatcaatgaccaaacaggccgcctgatcattcgtgaactgctgctcaaattcaaaacccagccgctcaaagaaagcgatagattccttcacatgatttaccggcaaattgatatacaaatgtttagattgtcgccccatgttcctctccttcttgaacacataatctcctttaagtatattcagctttttctccagaatccctttgtcaattgaaaaaatctgatgtcatcaaaaagaagcgcctcaacgataggcgcttccttcattatttcttatattcaatatggtacacatctcttcttcggtctttcagttgacgtacagtcccatcttgtctttgtcttcttaaaatttctaaatcgacatcacctacgacgaccatctcaatgtttggattacactctcctacaatcccatctcttgcaaattcaaagtctgatggggcaaatatagccgattgtgcatattgaacatccatattttcggtttgcggaaggttgccaactgttccagagataacggtataaatctggttttcaactgctctcgcctgtgcacagtaacgtactcttaaatagccttggcggtcttctgtacagaacggagtgaaaataattttcgctcctttgtccgctgcgatccgtgcaagctcaggaaattctatatcgtagcaaatttggatcgcaattttgccgcaatccgtatcaaatacccggacttggtcacctgctgaaatcccccaccattttctttcatttggcgtgatgtgaagtttatattgtttttcaatcgttccatcacgtctaaataaataggcaatattgtagattttcccttcctcttctacaaagtgggaaccgccgatgatattaatgttatatttcacagaaaggtctgtgaacaaattgatgtagtcctctgtatattccgtgatccgctgcacggcaagacttggtgaccgctcttctaaataagacatgagctgcgtcgtgaaaatttctgggaatacggcaaagtcagctgatgcatctgatgcgacatccacataatactcgacctggttcataaattcttcaaaggaatgaatttgtttcattgcatattgaattacacaaattcgaacagggaacgccgatttataatatcttttcgattgcgggcgataatcgacattgttccattccattaacgtcgcatatgtgctggatgctttatcatctggcaagtaattcggattgatccgcatgagactaaattcatttaacagctgaaaagataaaacaggatcataaatttggtgaagcatgacctgctcgacatactggcgaggcgtcatttcgtcttggtatttatgatagttcggaatgcgcccgccaatgatgatgctttttaaatttaatcttcttgctaagtcttttcttgcttcatacaaacgatgtccaattttcattcgtcggtattcaggactcaccatgacttcgattccgtacatattcattccatcaggattatggtttgtgatgtacccatcatctgtaatgtcctgccacgtgtggcgatcatcgtattcatcaaagttaattaataaacttgaacaagagccaataatttccccctcaaattcagcacaaaactgcccttctgggaaatgctcaagatggctttcaagatgctctcgtttccaaggatccatgccaggaaagcatacctcttgcaaggcaatgattcgatcaatatcctcttcccggatattacggatcaccattcttttttcaaatcgcgttaagtctagtttttctgccatgatgtatttgcccccttactgatcctctttttcaagctgatggaatagctggagcaattcgatttcagccatggattctaatctgacatcatattcttcaaattgcagcgtgctcgtcactttgtttgggacgatgacacatttcatgcctgcgcgtttggcagctactgatccatttacagaatcctcaaatgccacgcaatcttttggctctacccctaagcagcgtgcggtttgcaaatagagctctggatttggtttcacttcttccacatcatctgatgtgcggatacattcaaagtagtcgaaaagaccaatctgcttcaggtgatcagacacccatttatagtctgagctggaagcaagtccaatcttaatccccagctcctttgctgcttctaaataagcttctacgccaggtcttgctgattcgtccttcattctttgttgaaaacgagaacgccgatctgctgtgagtgtctcatgatccagcgtcttccctagctgcttttccaaatattcaaatggcttaaagcctgcctgcgtgccaatgaccttgccccatacagaaagaggcagatctgacttgtgctccgcaaacatttcttgtaaaacctcatattcatgtgtttctgtatctaaaattaatccgtcaaaatcaaatataatcgcctttaccaacgaggccactcctttttttacaaaagtcttaaacatatactccatgctatcatatcgtgaataaaattgactttcaaagatgaatgtctgctaaaatgattatgtataaaaggagcctgcaccattttgtcaggctcctacccgtgttcgatttattctgcaagagatccaagcgctccgattcgtggagaaataggcaatattgaaaaagagcgggtttggtattacagatcttaaaggtttctccgttcccttaaaaatagtatgtgcgagggccttgtaagttaacaaggaagttcacaccatcttttacgcattttgaaggtgacggctgacaaaatcgtctagatcaaaaggaaaagaaaagccgcaggcattgacctgctcacggtttcgctcgaataactcacgatcacgtttggtgatatgacgtttcggttttacaataatggtatgtaatagctgaagtcccgataaaatacgaaaagcatcatccatcgtcccgttatatacgccatcaataaaggtaagggaacgatctttttgacgcatatcccgctgctgtccattgacagcatgagaaagaagatcttcaacatcctttgatatttcttcaattgcctgctcttgcaggtctgtagcagctttcattaatctcatgtgacatctacctctctgtcgttatttctccattcagaatagcacagaaaaaaaggcgttcgccaaggtaagtgtttcctatatatacccatagagaggaacggatatcatgatcataaaaggacacacgctctcactcaaagtagacgagcagtatcatcacacatcactcagtcattttttaaagacggccgtatctgcatcaaaaccaattgttcatttttggatggagcatcaaaaagtccgtttaaatcaaaagcctgcccatcacgcggttaaagtcagtcaaggcgaccagatcatcattgatttatttgaaacagaagaaagtgatgtgacaccggaatacggtgaattagaggtactcttcgaagacgagcatttattaattgtgcaaaaacctgccggacgacccactcatccgaatgaacaaggacaaacaggcacactggcaaatcttgtggcgttccattttcaagcaaatggagaagaaaagcgggtaagacatatccacagacttgatcaagatacgagcggcaccgtcatatttgcaaagcatagattagcccatgcggctcttgatcaaatgctttctaaaaaaacaatcaaacgtacatacatcgccatcgcagagggacttttcaaaaagaagaaaggcaccatcgatgcagcgatcggccgtgacaaacaccatgcagtcaaacgaagaatctcccctacagggcaaaaagctgtgactcattttcaggtcatggacataaataaacgtttgcaactaacagcggttaaacttcaactagagacgggtagaacgcatcaaattcgtgttcacctgagcagtatcgggcatccactatctggggatacattatatgacggagttcgtgaatacatcaccaggtgtgctcttcacgccaagcaagtagacatgaaacatccttttacaggtgagcatctgatcatagaagcacctctaccacctgatatggaccagctcatgagtcaaatcatccattaacaaaagagcctgctttcatacgcaggctctttttctttattcagacactctttttgcataaataatataccgctctggcgcattgccaacgaaatgaaaaggatagcatgtggttaatatcagctcttccttttcattctgcaatgtaatgatggatgtatcatgctgatcgacaatttttgtatgtgtgatttcatatataaattcaccatacggcacagtgattttcagttgatctctaatatccaactcgcctgtccggcgaaacaccgtgtcacgatggccagaaaggacgatttgtccattttgatccggataataactgtctttgtagtgtcctactccctttgcaaggtcatccgcatccgtcccttcgacaatgggaaggtctgcttttaattttggaatcgtcaggatgccagaggctttccccatttcaggagcaaactgcttcttggacatcccctgatcgtccgccacgaccttcttcgcttcgtctaatgattgggctgtttgaagatgagtcgatgcgatttgccaaattccccagccgagaagtacaatcccagctgtcatcacagtcagtgcaagccactttttcatgcttaaactcctttgcttgttccatttctcttagatgatacgctctttagcttgctgctttttcttcttgttttgctttttgaattcgtccctctttttgatacacaatggaagctccctcaaagcttttcacaaaatcgacagtcgcttctaagtcttctgggcctgtttcagggttttgccccagcctgcctatcggtgcatatttactgccagttgcagttgccatgaagttattcacagtgagtgtatacgtttgatcaagagctacagctgaaccgtctggcagcttcaagtcgactactttatatgttaccggatcataggaatatgaaaagcctgaaatgctataatctggtccaaattgtggagaaatttgtgcttctatgatctctactaagtcttttcccttgatctctagtttgactaaaacgttgccaaatggctgaatattaaagagatctccccacgttatcggccctttttcaaggttttgcctaatgccgcctccattcatcatggcaaagtcacttttcattgaatatctcataccatccgcaatcaaattaccaagcggcgtgtctccatcatttgaatagccgccttccattttgaccccggcttctccaacaacctcactaattatcggctccacttctttcccgtaatgtgccaagatgtctgctgcttccttgtccttttctatacctgcttgatctatatactggattttcgcactctttttgacgatatccttcgttttacggtcaagtgtcacattgacttcgccaatcgcctttccatattcaaaggcttgcacaattaattttccattgacctctccattgaccacttcgtgattatgccctgcaaagatgacgtcaatttcatcatcaccttctttggcaagctttgcactctctccagtgattgtatctccattttgagaggctgtcatatgagctaaaaccgctatggctttaattcctttttgttttaattccttcgtggcttcattcacggctttgacttcatctgtaaactgaatgtctttaatcccttctggcatgaccattcctgcggctgacttggtcacaacgccgataaatgcgactgggattccatcgacatcgatgatttcataagctggtaaaagcggtttgccagtatccttgtattcacagttcgcacaaacgagcggaaagttctgtccgtcatacccctttgtgcctttaggatgatctccgccatttaagatacgcaatagctcgtctaccccttcatcgaattcatggttgccgaccgtgcccacatcaaatccaatgttctccatgagttcaacggttggttcatcttgtagaagagaagatattggagagctcccgccaatcatatctccggcatggaccgtaatcgtatttttgtgcgctgcttgtttttgcttcatataggccgcgacataatccattcgtccatacatgcctttattgccatcaccttttagatccagctcgtattcttgatcaattttaccgtgtaaatcattcatacttaaaatcgttaatggtacgtcgtccgcatcctttacaggctgataaccagcctgttctgcttcttctttggaagcaaaaaagatccgtttgtccacatcgatttctttccatttgtcaggagacacgtaggttttgacagatgagtcaccaacatagcgtgtcagtccttttttctgttcacgtgctctaaattcaaacggctgttccagcagagggtccgcttcgttccatatgcccagtcctttttcctttgcttcctttactgctttttgatacgtatgatagtccttttcatctcctactggccagatgaaataagtaggagcatatccttttttcacaagctctagatttgtatttaacccttttttggttttcacttgagctaaaagacgtccatagttatcctttgcttcaggaccaatctttaatgtgacctggtcaccgctcaaaagcagtgtttttaaatagtcagttgcttgctgtccaaaacgcaattggtttttgtctaattcgctttttggctgatgatacgtttcaggcgtgtccatattcacaaagcgcacctttgttgtacctaaaacggccttctttagatgaatcgtatctccatccaccacacggtcaaccgttgctttgtattctttcttcatctttggcggctttggctggcgtttcagcaggttgatatcatccttatgtcttggaagcacctgcagcgtatcatacctgcttaacacccctgtaaactcgtaccatttccctgtctttactttatcaatcgcattcgtatcgaccatcactctcagagtggtgctgtgatattttttatcaatgatcaccacattgtatccaccgccagccggctgcgctggttttgcctctacatagcctttgagctttacaagtcttccttcatgtttaccggcttgttccgtttctagctgcttcacagatactcgcttcgcctttggcaaggtttggttcacagcatctatcttcagactgccttgatctggcacaatttcaatcagtcctttataagacgtgattttaccagtcactgtcaccttcatccctgcttttagttccgagaagtgattgggctgcgctgaataaacattgattccagctgatttgtcttgaatgtatgtggacagtttcccattgccaacagctgattgatctgctgtcacaattccgctcaccgtcacagtctctcctatgagctgacgggcttttttgatctgcacaatctttttttgtttccacaccatttctttcttttcagatgcattgacctcgctccctgcggacatgccaggcaataaggattgcaaactaaagatcaccaaaaccaaacaacaaatcattcgaatagatagcattcgtctcattagacctctcccctttgcgcttcatctctcatagtgtacaaagtaaatattgatgttgaatggatttcatgtaaaacttgtcttttttaactcatcggaaaggtaataatcactcgtgtcccctcaaagcttttgctttcaaaacgaatggtgccgccatggctttcgatgattttaatggtcatcattaaaccaaggcctgtccccttttcttttgttgtataaaatggttcaccgagtttccctatttcgtcctctggtattccctttccttggtcttcaaagatcagcatcatttgctgatctttcatgagagaggccaccttgatgacgcctgtcacaccatccatcgcttctattccatttttaaggatgtttaggaagacttgttttagttcattcggaatgccttgaatgttagggagcgacggagacagctttttctgaatggacacgccttttaagaccgcctgagattcaacgaccatgatcacttcttcgagcagaagattgacatgtactggttcaaatttcaccgatttgcttctagaaagaacgaggaattcattaataatcgactcgagccgattaaactctgacatcatcacatctgcataatctttctgatacttcttactttgaatcatcagctgtaaaaatccttttaatgaggtcagcgggttccgtatctcatgagcgatgcctgctgcaagctgccctactgctgacagcatctctgatttcatcagcatcttctctgactgcttttgattggtgatatcctctgaaatccgcatgacggttgactgcattttgtcagggtcatcaattcgatgtaaagagactctctcccatcgttcacgtccagataaatcttgaaagtacagctcacctgtccaactgccctctcttaaacaaaccttccattgcttctctaaatcatcacattgacatagtgaatgatagacagaaaaaatatctttgccgatcaggtcatattcatgttgctggacaaactgacagaaacgctggttcacgcattggatgactccttcctcagttgccacaacaatatgaatatggctgttatcaagtgccgttaccgctagatgaagcgactgcttgattttcgttacttcagtcattttaatccaagtcatcaccgcgccttcatgttcttcatcgtagatgggtgtgatgtgaacagtgaattgctcgccttcgttcgtttcaatttcacgttcgatcgcgcgcctattcgatatgacggattggatatcatgatagagcgtttcctgcgtaagctttttagccatcgactgaaaggattgctgatgtctgattttcgcagaagtaaataaagaggcagctgtaggagtgtaatagtgtatattcatgtccctgtccacaaacagcgttgccagctccggcttgacagagggtctgtacagttcttctctcgtcacccttaaattgtttatgatatttatataatgctcgtgttttttctcaaactcctctaattgcgtgtgttttgcttttaattgagcccttgcctcctgctccttttgtttgacttcattgagttcattttccaaatcgacaatacgctgttgatagactgaattctgatctgacatccctatgtccctgccgttcttttgatttttccctctctcattcattcgaatgagaatgacgtaaactcccttaaaacggcggtcaaaacttttcacggtaaaatctgcatactgctttctgcctttttccgaaatgagaacatgttgaaacacaacctctgtctcgtctgtccacaccttttgaaaggtttgactgagcatctctttcatataatcaggtgtcacatattcacatgattgatctgacacttctgtatgatctaaaaaagaatacgcaccctttgatactgccaggattttgtcactatcgttgatgaccatacatgcatcataatccttgcttacttcttgcatatattgttcggctcgcgctttcaactcgatatcacgagcgtctggtgtccaagggacatgtggttttgaaacgtttgaatgagtgtaaatgttccatttttcattgaacaaatgaaacaaacgagggatattgggtacagtttcatttggccctaatatcaacatcccttggtcttttaaagcatattggaatcgggacaatactcgtttttgcacttcaggctggaagtacatcagaacatttcggcaactgataaaatcgaggtggataaaaggtgaatcgatcaataaattgtgaggtgcaaagacaatatgttttctaagcgactgcttcacaataaaagcgtcacctttcctttcgaaatatcgcgcccgccatttttccggcatccttgccatagactctactgagtaaagacctttactagctgtttgaatggctttccggttgatatctgttgcaaatacttgaagttcaatggtcacttgtcttcgcttcatttcttctaaaaataagatcgtaaaagaataggcttcctctcctgtcgaacatccagcaatccaaatacggcatcgagatttcccgtttttcaccgcattttcaatgatcgacggaatgatctgatgttcacatacatgaaaagcctccatatctctaaaaaaagatgtcataccgcttagaagctgtacgtgcagaaggtcaagctcatctggttctctttctaataagttgtcgtattctgataataatgaaatccgtttttttgcaaccttcattcgtttttgaatgacagatagcagccttttcctttcataggttgaaaaggcaatgcctttatacatttcaagtcgttcaataattctcagtaaaacaggatctgcctcatcgatgtgcggaacattcatgatattggagatatatgccgcaagggtggtaggatccttgaatgtttgttgatacaaggtgtcaaaaccactttcttcctcactgcacgataaagctgtaccgccctgctcaaccaactgaagcaagccacttcccacgcaatgacctttttgaaagaaaatcgcataagcctcctccttttgaacgctggcaagagactgaaaaagcaagtccacagagcaagccatgcacgccggcagctggtctgataggtgcagcctctgatcttctgttaacgtcaccaccgcatgctgtggacaaaaataaatcgtcttcttcatgactttctcaccatgtttaatcgtttttgcccggtagccaatcggtaaaacaagtgcttccaaatcagttatacaatcgcctgtcacatgattttgcacaacaataaaagaggcatttaattcatgtggaaatgattgaaaaaaagcctcaagatgatgctgttcaaacggcgaaacaccgatgccaatcactggtgtctgcacatgttcgtcttctatcaaacgattaatgattttgtcctgcatctggtacccccatgttcattcgtctgatactttttttcgacaaaaaggaagaaaaccctctaattgtaaataatgtttttgcatgaaagaaggaaaacatcctcacattaaaacagaatgtataaacaataggaggaatctctatgcaaaacgatcagcagacaaacgttcaaggaaatgtccagcagccccaattcaatcatggcgggcatgagttatttgatttacatgaagtattagcagggaccattaatattttggatcaatacatgatctttcgccaattcatccaagatcccgcattatccgacattttagatcgacaatatcaatttgtattgtcacagtataatgtcacagtagattgtttttctactggtcaaaagcctagtgaagaaacatctacgtatatgatgaaagaacaaacacaggtgacatacggaataaagccatctcagcctaagaagccaaatcaatcgttacaggatgtaaaagacacgggaattacagggcatatgctaggtctcgtgaaatcacatgctggattactttcaatgactgcactagaggtaacaaaccctgtggtgcgacgtgtgcttgcagcgcaaattccgaactttattgaaatggcgtatgaaattttcttatatcaaaataaacatagctattatcaagttccgcagcttacagctcaagatatgcaggcgatgacgtctacatttgccccaatgaagggccaagttcaaatgccgccaaacaaagccaatcagcaaaaaccgctccattaaataaaaaacggccgacctatatcctcaggtcagccgttttttatttgatatatcttgttaaactgatcttcaaaatctgcgagccgctgtcctgtcgcttgttcaaaacctctatcaaaacggccagttttcgccgtttcctccataatctcatgtatgacgtctcgtccataaagctgcacgagctcataaatcatatagtagctttgcacataaacatctgtctcatacgtcatccgggagtcctgccaatcttgatcggaatgaagagattgaaagggaatgacgtcgaaccgttcagacgtagcatttaacacatcataggccgtccattctgcagttccctcatggaaccaaaggggaaagatcaccggagacacttcgtaagaatgaactttttcatagaaaacaaagtgagcatattcatgaatcaataacgtgttgaaaaagtataaagggagtgtctctttcttcaataatgcttcccgtttgtctggatataaccctatcatttgatcatgatcagagtaaaaacctgtaatatgcttgatcccggcaaattgctcgattgtctctttatcatcaaaataaataatgtctaaaggtttgtcagtttcaaattgaaacactgacgctgtcctcttctttgcctgatccatggcctcgattgtcaaatcaacaaaagcgtcctcttcctctgcatagtatattctaatatgttcatagacttgcttattgagtccctccgttagaattgttttaggagaagactgctgctctaaatattgtcctgtcagctgaaacgcaacataaatcaagtacgcggtgaaagcataaaaaatgagacctgctgctatcattccgcctactagctttttatgaatcaaagacgacttggctttcatttgctccccacctgaattcatcctgcagcctctttctctttctatgaagaaacaaagatcaacaagaggtgatatattttttactttatgcagtcaggtgcgcaaggtgcggttccaaacaaaaaagccgcatatgacatacggcttttgtcgtagctattttgattcagggaagacacgtctgaccgtatcagtaaattcatcgaaaaatcctgagataggctctccgcttctaatacgttttccgtacccttccatgcggtcgacaaagtctggattggcagatacatacacattgtcgatttgttgatccgttgatttgactttatcagaaattttctttttcaaatcttctgccacattaccgcttttatcgccttcaagcataacggcaacaaatgcattctttcctgtaacaagtacgttcgctgtttttacttcagacatgttggctacaagctctgacgctttatctgccactttgaccttctgaggtgtttggacattttgctgatcctgcctcatgttgtcattcttatatgtgacattttcatactgtcgtttcattgttcctcttcgctcgtctccttggttgttcataccacatccagtggtgatcaatgctggaacgagtagtaaagatagcatccatttcttattcatcaattattccctccttttgctcttaggtttttcattcagccggctttttatgcatccatcctctctttcagcgaaatgaattcataattcagctttgtttggtcatcctaaacatgatgaagaagtatcatcacgatcaaatggagggattcgtttgtttaaaaaaagaaaaggcatgagcactggcgcaatgatcgcagcatcaacagccatcattgcattattttccccggttttaagaagaagactgaaaagcatgacgcaaatgaatatgtcttcaatgatgaagggaaaagatcaacagcaccatgactcgactcgacacgagtcacacacacagaaagaatcaaagggcactgcggaaatcggacaaatgatgaagcaagcattcactgctgtacagccaaaccattcgaatcagcacaaatcaacatcaagaaaccatcagccaagagagtcttatgcacagtctctccatattgatgaaagtgtcatgaatgtgatggatgatgaatcaatccagcaagtgatcaatgacatcgagcacaaataagaaaacaggagccttcatgtatagaggctcctgtttattctcctgaaaaatgttctttcaccatcacagagaagaaaggtaaaaaggtgatttcaactgttgccataaaatcgtgataagcttccattatgattaaaagctctttttcgttcggccggtcctttttgatctctacatgctgcacagttttaaaatcatagatgcctaaaacagatccatctttttttcgaacagcttttaacgtaaattcttgtcttccaaggtacatcgtgacaacgaagcgctcgtcttgattctcaaatcgaaatgtcaggctttgatattcaataggcatccctttctcgaacctttcatcaggctccgtttcaaaaaaagaaagccagtccgtttcatctgggaaacgttttcctcgcatgtgtttcgttcccctcataagtgaaatttttattaattatcctttttccccttttcttttgcaacaaattttagtaattttaaaaaggtgatttaattttgctaagagacctctttattaatttaacaattcttgtcactttccattatttatttatgcttgtgtttaaagagaatttccttaagaaagaagataccctgctcaggcaactatgcaaaggcattctttctgggttactcggtgtccttttaatgttcttctctatcaaagcaggaccagccatcatcgatttaagacatatcccccttattttaacggccttttacggaggcatcgcccaaaccatcattgcagcctttgttgtgatcattggtcgattattaatcgaagccaacgtcgcttctttcatcaatattttttccatgatgatcatcgcaactgcttcttttttaattgctgaacggcatatgaatcatgttgtgaaaatgctgttgtccattacgttaggtaatgtgattgccacaagcctatttatcttaatcgtgcatgagacatcatttgaactgcattttgcttattggatgttctcatttattgcaggattgtttaacttttacgtcattgagcatcaaactaaagcatatcagctgctgaatttgtataaattccaagctcattatgattttttaacaggtgttttaaataaacggaagttcgatgaggtcttaaatgatgctttttcgatgaaatttaagcagcctatccatcaaatgtcccttatttacttagacattgattacttcaaatccatcaatgaccaatatggacatcatgagggagatatggttttaaaagaaatcggaaaaaggctgatcaaaaacacaagaagctctgattatattggccggatcggcggcgaggaatttgcagtctttctaccaaattgtacagttgaaaaaacatggcagattgcagaacgcttacggagaaaaatagcagatcagccggtttatttacaaaatggcatgtccattcatattacagtatcacttgggtgtgcgtattaccccgggacaagtccagatatcaaacaattaccgattatagctgaccaggagctctataaagcgaagcagtctggccgaaatcaagtgagcttctcagggagaaaaagaggccaatgaatataggctttttcctcaatttgttatcgctaattatttttaaaaaagttttcgtataacagttgttttttcccgcaaacactggtaaagtaaaggtaattatttttgttcgtatcatctttaagaagaaagttttgaaagagttttcgtctttgaagtttgtgtaagagcaagaatagtgaatttaagcgttatgatcgctttaggaggaaatttcatgttagaaggtaaagtaaaatggttcaactctgaaaaaggtttcggattcatcgaagtagaaggtcaagacgatgtattcgttcacttctctgctatccaaggcgaaggcttcaaaactttagaagaaggtcaagcagtttctttcgaaatcgttgaaggtaaccgtggaccacaagctgctaacgttaacaaagcgtaatttaagagcatctgctctttagcactttatagagtgaaggaaaaccgcccggcttctgccggcggtttttttgtgccataataaaaaagagaacctgacgagaggttctcttttttatttgtccttctgctttagcttctgcaaagcagaacgatacatatcatcattcatttttgtctctggttcttcttctttgacaggtggttctggctgcttaaacttttgaagcgcctgtctatagaaatcatctccagacactcgttcatccgtttgaagaggcgttgacgcttcctcttctacttcaggctctacaggtctcgccgcaacttctgactcgctacgggccacgtcaggctgattgggcacatcttcattgatctctttcttctcgaccgaagcgtgtctaacattgaatgctactaatccgataatgactagaacagcagctactaacgctacaataatcgtcgccaaaagaaccctctccttatcgcttaaatgacgcagtgactgatgctacacgtcttcctaatgctttcccgagttcaatgccttctgtcgaaatcacttcatcagaatcaatcggacatgtcacacctgctccatagtaagagccgtataaagcattttctggcacatttccaggaagaccaacgacaagcatcccttggtggaacattggtgtaatcaaattatgcattgtcatttctaaaccgccgtgcgttgtagcagttgtacagaaaacggcaccgactttatcgattagttttccctctgcccatagatagccaagacggtcaatccatgtctttaatccagcactaatggtcccaaagtgaccagggcagccccaaatgattgcatccatttgatcaagcttgcgaatatcagcatcttttacgtgatcaacgaatacttctgcctgctctgtttcacctgcacccgctgcaattgcttctgccagtgctttcgtatggtcaccttcactatcgtatacgacataaattttcatgtacggtccctccacacttatcttgcatcttgatttgcttccttaggtgctggaagcagtgtcatttcttgttttttatgctgctgatcttttcgctttttatccttacgtacatcacgcaggaacaagctgagaatgacaccagcggcacagaataacgttacccacatgtaagcatcattgatacccattacgtttgaatcaacctgtgctttcgtaaagagctgggtagatacatatttttgagcagcttcagctgtcatgcccatatggtgcatcacattcgacacagccgcctggaatgaattcataaagaacgggtccgctgtatttgtttgatccgccatattggaataatggaatgttgtccgattcgtataaatcgttgtgatcaaactcgtaccgatcgaaccgcttatttgtcttaatgtattagacatcgctgtcccatggctgtttaagtgctgtggtagttggttcatcccagctgtcatcaccggcatcataaggagtgacataccgaatgcacgaattgcatacatgagcacaatgtgactatatgatgtatcaatagtcagccttgtaaactcgaatgtggtgacaacggtaatgagcatccccacaatcgcaagcggacgaggtccaaatttatcaaacaaaatacctgaaatcggggacataatcagcatcgcaagtgctcctggaagcattaatagcccggattgcaatgcggtaaacccaacgaggttctgcagataaatcggaagtaagaacatcccagtgtataaggcaactgtaataataatattaatgacacttgataatgagaaaatgctgtatttaaacactcggaaatcaagcatcggattatcagctttcagctgttggaaaataaagagaatgatcgcaatcgcacctacaataatcgtcgataagacgatcggatctgtccagccatcacttccagcttcactcactccgtataggagcgaagcaaaaccaacgatggaaagaatcgcaccaaggctgtccagcttgatctttttaggctctacaatatttctaaacataaagaaagccgcgataatgacaattgctccgattggaacaagtccataaaacataatacgccaagaataatgttcaataatgtaaccagataaagttggtcctaccgcaggagcaaacatcatcgcaagaccgaaaatccccattcctttccctctgttttctggagggaaaataaaaaggattgttgtcattacgagtggctgcagaataccgccgccgactgcctgaatcagacggccgatgagcatggtcgaaaagttcggtgcaatcccgcaaataaaggtccctagtgtaaacgagatcatggcaactaggaataaactgcgctgtccaaagcgtgtgattaaaaacgcagataacggaatcagcacaccgttgacaagcatataacctgttgtaagccactgaatcgtcgttgcactcacattaaattcagtcattaaatggggcatagctacgttcagaagtgtttggttcaaaatcgcgacgaacaagccggccattaaaatgatcagtaaagacaaggagcctgctccctgttttgttgctgcaggttgatttgccatctcagacaacctcctttcattttttgatatcaatcatcattaagatgaaattttgacagaagcattcataccaggaagtactttgtctgatggatttttaattgaaattttcactgctactttttgtgtcacttttgtatagttaccacttgagtttgttgctggcagcatgttgaatgttgaatttgtcgcataaccaatttgttcaactgttccttcaaatgttgtatcaggatcaccatctaccacgatgtcgactttgtcgcctttttcaatgtttttaatatctgtttctttgatatttgctgtgatgtaaagcttgcttaaatcaatcgtttcaccaagaactgtaccaggctgcacttgttgattattttgtacttcttttttgactaatgtgccatcagccactgatttaacgtttgtttttgtttctccttcaacttttgcaacagtgctgtctttttgcacttcgtcaccttcattgatatcccagcctttgatttgtccagctgctggtgctgtgatttgatacatgtcacctgttactttcgcctcgtcagttttgacaaaatttgtgctttcgtagtagtaataagcacctccggcaataatggcaagaatcacaataaggccaataatgttcgttagcaataaacgccctctgttcatgttttgtttctcctttcatgtataaaaatatagtgtcatctgctttagcaaacttagaatgcccatcatctgacagaatatgaagtaagctcataaaactgttatttccccttcatcttccccgcatgaataatggtgtgcagcccatttatacttattgttcactcatgagcaaagagtagaaaaagaagaaaagaagatcggcatcttttttgaaaaacttatatttaacaagattaaatattaataaatgaaaattgaaatgtcaaagagaaagttttactttttttctggtgatcccttccttctccatacaaaaaacccttcagcccttatactgaaaggtttttttaaatgtgctatttacgaaagaacttcttcctgctgaaaaaatttttttagggcgagaaaaacatctgatttttgcttcaaaatataatgcttaaatttctcatcctgtatatgcttatatgctgacattaatgtggaatgccggttgtattgattcacttctccataacagaataagttggcttttttcataatttcagaaacaagtttcacgcaccgtgcattgtctgaggtcaaattgtctccatcagaaaaatgaaaaggataaatattatatcgtgacggcgggtaacgttcgtctatgagctctagcgcctttcgatagacagaggagcaaatcgtccccccgctctcaccgcgcgagaagaaatgctcttcatctacaaccttcgcctctgtatgatgggcaataaattcaatatcgaccgtctcatactttgtccgtaagaaacgtgtcatccaaaagaaaaaacttcttgccatatatttttcccaaagtcccatacttccgctcgtatccatcattgccaaaacgacggctttggactctggtttggtcacttcattccacgtcttatatttgatatcctctgggtagattggataaaaggaaggactgcctgtcattgcatttcgtttaaatgctgacagcatcgttcgttttttatgaatattccctgttaacccggttttgcgaatatcgttaaactcaatttgctcgacaatgatgtcgtcaagctccttttgtttaaggtttggcagctctaattcccgaaacagcgcttcctcaagatccattaatgagacctcagcttcgtaataatcctctccagcctgatctcctgcgctctgcccctttccttgcccttgcttactgtctgatccatcacgtgcgacaatatcgcctacctcgctgtctccatcgccttgacccacatgcttatttttatcgtagttgtaccgaattttatattcatctaacgaacgaattggaattttaacaacatcttttccattagacatgataatgctctcttctgtgacaagatccggcaaattgtttttaatcgcttctttgacctttttctgatgacgctgctggtcgtcatagccttttcgatggagggaccagtcttcctgagatacaataaactgacttttttcttgccgggacatccatccccctcctcacctgtttgcactattcttctaaccaccgattcctttatcttatgctgctcgtcacccaagttgacggtcatttctaaaaaagacattaccggtgcaggtgcgccaataatgcctccttcatttattaacgattgagaagactgcctacatattttaaaagttcatttgcacttgttgaattatagccatgttcatcaattaatctagccactacttcattcactttcttcagctgctgttcatccggtgtcttcgttgacgtcgtgatttttaccacatcttttaaatcagcaaacagcttcttctgaatcgcctcacgcaatctctcatgagaattataatcaaagcgtttgccctttctcgcataagccgaaatacgaatcagaatttcttctctgaaagcctttttggcgttttcagaaatcccgatctgctcttcaattgaacgcataagcttctcatcaggattcatttcttcaccggttaatggatcacgcagcttgtttttgttgcaataggcctcgacattatctaagtaattatccatgagcgttttcgctgactcctcataggaatacacaaatgccttttgtacttccttcttcgcaatatcgtcgtactcttttcgcgcaacagaaataaaattcaaatagcgctcccggtcctcgcttgagatagatggatgctgatcgagcccttcttttaacgaacgaaggacatccagcgcattgatagattccatattcttccttataatggtggaggaaatgcggttaatgacataccgcggatcaattccgctcatcccttcatcatgaaattcctttttcatctcatcaatatcagcagattggaagccctcgacactttctccgtcatacagacgcatttttttcaccaaatcaatatcagaacgcttcggctctttgagtcttgtcaaaatggagaacatcgctgccaccttcagtgtatgcggggcaatatgcacacctgcgacatcactttctgaaatcattttatgataaatgcgttcctcctctgttaccttcaagttataaggaattggcatcacaataattcttgaatgcaaggcctcgttctttttatttgaaataaatgacctgtactcggtttcattcgtatgagcaacgatcaattcatctgcactaatcaaggcaaaacggcctgctttaaaatttccttcctgcgttaatgacagaagatgccataaaaatttctcatcacactttaacatctcctgaaactccatcatcccgcggtttgctttattgagttctccatcaaagcggtaggcccttggatctgactctgatccaaattcagcaatggttgaaaaatcgatgctccctgttaaatcagcaatgtcctgagatttcggatcagacggactaaaggtaccaataccggtccgtttatcctctgagaaaaagatccgttcaacccttacatcctcaattcgtccgccatattcctcttccagcctcatcgtattgagaggagacaaattcccctgcacacgaatgccatactctctatagaaatcctcccgcagattttgcggaataagatgaagcggatcttcatgcattgggcagcctttgatcgcatagactgcgccattatctgtcagtgaatattcttctagtcctcttttcagcctagtaacaagcgtagatttccccccgctcactggtcccatcaataacaaaatacgcttcctcacatcgagccgcttggcagcagggtgaaaatattcctccactaatctttcgagtgattcctctaatccaaaaagctcctgatcaaaaaatttgtacgttctgaccccattctcctcttcaatcccgctgtctttaatcatatgataaacgcgagaatgagcagattgagcgacaagtggattttcctttattatgtctaaatactcgccaaatgtgccttcccatttaagacgctgctcttcttctctgtgctgttcgattttctttaaaatatccatatgaacctcctctttcaagattgaagcaagtaatcagatactgttttacaatctatgcggaggcgtcctattacatgctttcgttcttcaaaatgacgaattggcaaactgaattgacaaccatccgcaagacccttcataataaaggaaaaacaggagaaaaatgatcttcttctcctgcttttcagaggcgaacttcacatcatatgaaacaggcagcgatcgaaacaaagggataagggggagcttatatgagaacggtcattatgatgggcgtcatcattacgtttttagtatccattttcacagctggctacgaaggcaagcctggtaaatgaaaaaaaggatgttccattagcggaacatccttttttcatttagttcgttgtttttagcacctgcatattcactgtatttcctgatacctgaatggacgtaaagtcttgcgtatcaatcacaggtgtgacggcacgactgtctaatgtaatgtcagtaaaacgagtagagaagttcgcacgaatatctttccggtagatatcgtcagtcactgctactgtggacagtaatttccacttcgtcacagagccaatgtttgagttttggatttccgtgatgatacgcccggtataaccaacattatttgtcccccagaacgttgctcttgtatgtccattcaagtttttgtaaatggtcatttgcacagtacttccaggcttaaatccttttgtatacgtaaagtcatttttcccttcgatatatgtctcttgattatttgctcctactttcatcgtaggtttccacacattataagttgaactgtattgaagaccaatatccgcttcctttgatcctgtgaacccagaataaatataagctgtcccatttgacacacttattgcggaagggagttgaatctttgtgaccaatatagatccattgctattgatataagtacgcccgccgatacctttcgatagttgcgctgcttctatttcctgcgttagagagagacctgggatactgactggaatcgtccccattaaaatagctgaactaatggcactagtgatcagtagctttttcatctcatttttcctcctaatggattcattttttgaaaacgttatcacaatctatcatactacctatttttttacatgtcaaaaaaagtataaaagtgtcgtattttccttctttttgtttcttatttcatataaaaaagccgagatcagtatcccggctttcatgatgaccttaaatcagatcacggtattgctgctggcgaagtgcctcatacacaagaattgctgccgtattcgatagattcagagaacgaacatgttctgtcatcggtaaacgaagacagcggtccatattccgctcgatcaaatccttcggcaatccacttgtctctctgccaaaaacgaagaaatagtcttcatctagctgagagtaatcaaatgtcgtatgcggcttttgaccaaattttgtaatatagaagaattgtcccttcggatgagcctcaaacaattcatcaagcgagtcatgatagaccacattggcatatttccaataatcgagtcctgcacgcttcagcattttatcatctgtcgaaaaaccaagcggacgaatcagatgaagggttgtatttgttgctgcacatgtacgcgcaatatttccagtattagctggaatctctggttgatataaaacgacatgaagtcccaaaaaagttcacctctaattttcttttccgctcaacattataccattaactatcctttgcggcatcgtccaaaatgtgaaaaaacatataacgaatagctggtgtataggcggtcgaatcctcatacgaccaataacgcatacggctgtcatatgtctgagcattcacaagaggcatcccgcctttatcgtgatcgacgacaatggttgtatgattatacctgccatctccctcaaaatcgtagcaaatgacatcaccaatttgtagctcctgcgcttcttttagtttctttgctcttaaacccgctttcgaattcgctaaataatttttcatcgaatgagctactgtccagctatagctccacgtatgtggcctcacccaccagccagatccacggttcggatatcctctcgttggcgcattccctgcctttaagcattgtgaaataaaatttgtgcagttatcttcaaaatttttataggcaggatttcgtttattccagtacgtctccgcatattgcacggctgcccgccggtcatagtgaaaggctctcccaaactgttcttcggtctgaaagcgctcatccacttgctcttccatttgacgttcttctatcatcaatcgatcttttacaagcatgtcgttgtaaaggaacgcttctcttttttctacctgttcctctaaataaaaagaatcgtctacatccttgcatacataagtgagatgagcgagatactgcacatgctgagcaccgtcatcctgaatcgatgaatctaggagtgttgctttggctttcgctttgacaatctccacctgtcttctagcaaaaagctcttttttccgttcgactgcttccacatcagacatcagctgcggctgtttgattgcactcccatttaataaataaccaagcctgtcttctaatgtttgctctaataattgtttcacacagacaccaccaaactttttttaaaatctctgtttggttcattctatgttcatagggatgttatttagtatttaaaggtgtctgtaaaagatccatccctttaacaatttcttgtttcgcttcttcatcactttcccgctcaatggctttttccagctctgggagcagctccacatcaccaattttccctattgcccaagcagccgtgccccgaataacaggccgtggatccttgtgcatcaaatcaatcaacacgggtaaggcagatgtatctttaaagtgtgcaagtgccaaaatcgcatttcgctgaatcggctttttcccccgccatgaacctgaaacatgaccgtatttttccttaaactctcgattactgatcgtaagaagcggctttaagagcggcttcgcaatttcaggatccggctccatttcaggatgcaggtgaaagtccttccctttattgatcgggcagactatttggcacgtatcacacccatataaacgatttcctattttcgaacgaaattcgtcaggcaaaaatccttttgtttgcgttaaaaaggaaatacaccgttgagaattcagttgtcctggatttacaagtgcaccagttggacatgaatctacacatttattacacgttccgcactggtcttcaattttttcatccggttcaaatgggacatttgtgatcatttcagccaaatacacgtaagacccaaactctggcgtgataatcatacagttcttcgcactaaaacctatgccagcacgttccgctactgcacgatcggacagttcccctgtgtccaccattgacttagttcgtatatcggcatgtttgcttcgcaagaattcttcgagcatatcgagcttttttttcagcacaacatgatagtctgttccccaagaagcacggcaaaagatccctcttcttgcatcctttgtacttcgaggagcatctttcattttggaaggatacgcgagcgctatcgcaacaattgatttggccttcggaagcagcaaagaagggtttgttcgtttttcgatatcaggctcttcaaagcctgacaaataccctaacgattcatgtaaaatgaggcggtcttttaatgaatcaaatgtatcagcacttgcaaatcggattttatcaacaccaatttctttcgcatattgaatcaattcttcttttaattctccaacatgaatcaccttgcaaacctcctttctttgtttattctattgttttcagtataatacgagtgtatcatgaccgattggagtgagtcactgtgaagatacatatggaaatttctcatcctgaaaacccatctatccatgttggacagattgaatattcgcatattgaagttggcacttccccgcaaatgttaaaaggtcggctccgcctgtttcaagaatctttattttttgaatacgaagataaagtcttagaagaagtaccagcaatcaaagaatggatggatcttttaaaagacatccctttcttgccaattcttgctgatatccaaaaggaacaatttattgactcgaccaattccgtacaggatttgtcgatctttttctctttaaaatatttcttgcctatcctgacattcgatgctgatcgaatagaagagccgctttcactagcaaaacatgagagaggtcacattgaatggcaggacaacgtaggacttaagggattattttctcaaccaagtaaagctcacatttctcaagacacaaaaaacattttgcaaatcatcctgtttccgccatctatttcccgggaaaagagtgaagctctcattcaatccttgacgaagatgtttgtacaaatacatggtggagaaagtaaatatgaacttattgaaaaagcactgtagcttgacagtgctttttcacattatactgacataataaaaaacgcaacacttcgtttatctaagaaacgaaatactgcgttataaacaaaattatgtattggagcgggtgatgagaatcgaactcacgacatcagcttggaaggctgaggttttaccactaaactacacccgcatcaatttttaaaaagcaacgtcatcgcgttgacttttattatgttacaactttcttaacaattcgtcaagagaatatgaagatttttcgtcaaaaaacttcatattctccgtatatattacgatagttatttatcgagctgaatataaaataagtaggcatgtgacttattcttcaacgcttgcttaggattttcctcaatcttttcaagcatcggtgaatttccgtctttccccattgccgctgtgtacgcaatcagtgcctttcctccagaagagactttgacagtttcagattgagcagagaaaacatagtcacttactttgaacggaaagcttgctgtcgctttcgtcattccctcgttcttgttgtctgaccacatactaaattgtgattcatatgtatctttctcatgtcttaattgtaagagcacattcatcgtttggtcggttccatcctgatgtaaagtaaaggtggcagatgatgcttccttattagctaatcggccatttttataatgactcccgataaacgtaatactcttatccttcttcgttaatccttttattgttaaagccaccatttcattagtggttgatgcttctagtaagctcttttctttttttgtcagtttcatttgttcaatggttactttctttttagtagactccttgtttattgtagataccgtcttctcggtttgcgtggtttcttcggccttctcgccgcatcctgctaatagaaaaacagtgaatataagaaaactccatttttttaacattgagatcccctttgatgttttttattttctattatactaaaatttggttttacatacaaaaaaagattaggagaattctcctaacctttcgcttttttctgcttcatggctgataagaaagccacaatgagaaaactcgcggcaaaaatcacaatcatataaataaaaaagtttggcttgatttgaaaagtaaatgcggatgaaccttccatctcaaaagcgagactgttaaataataaagcatcattcgtttttgattgaaataaatgataaaacaatacaccgattgtcagcatcggaaagcctaaaaaccccaagaaaccaccaacaatagcaccttgtttcatcgcctgtacgttcatgatcgttgtcctcccattcccccaagcaatagttgcttcataatggatttaccatcccccataaacggaagaagatagagtaattgaataaaatacgtgattgaaaaaataaagaagcctgttgaaattggattttcttttagacataatacggtcacaatgatccctgctgccccgatcacacctgggacaagcggcccaagcaaggtaatccatacctgctttttctgaaacggatctaatacgggtctcacaaatttcacagacatcatatcactcgcaaaaaacccttgtggaccatcccgtcccgcaaatttccgatgcgcatagccgtgtgctgcctcatgtaaggcggtcccggtaattaatccaaaataaataattgtaaaataaatcgcaatggctgcaatcgaccggtcaggaatgaataaaaaagcgagccctgccatgaccataaaaagcatccagaaaaaaatgattttacgtgtcaccatgagcaatgctgtcccaaaaatgtgaaggaacgagtgaccagtgcaatcaaatcgttccttcattttcacttgatactgtttaaaaaattgacagcaggctgttacaatccgatatggtgattgataatgaatagacattaagtggtgctgattcaaccccatcatcagttgataaaagtcacgagaaatcacagactcatcgacctgaaacaaatcagcgagctctgcggtaatactcgcttctgtccttttgccatctactttcgttagcatatgataggcactttcattaatcgggagtgtgcttccatactgcgtatccgtgagatgcctcttttgtaaggtcacatacggcgcaagtgccggtacccgctcaatctttagcttattgttaagaagttgaatcatgtgaatacctccatgaaaaacctttgtatatggcaaagatgagcagaccttcaaatgcagctacaagcagccactgaagtgtttgactcgactcccctatgacatagtttccaataaaaacaatcggaatcatgagtaaaataagtgctccaaatgaaaaaatgcctgtgtaaggattgttccgatcaagcggaagtaaaatacctaccacataaaagagcgcagtggcattgcataagacagcggccccaatcaatacgttccaaacctgatcaggaagcgtcagcgttgtcagcataaatattgcaatttgcagtacaccaacaagcaaaagcccgataaacttatacagagccacttcccaagaccttaggccaaacgttttgtacatccccagcattcgtttatcattgccaaatgaattaaaggcggttaatccagcgagagcgaagagaataaaaaatgcttcttcttcaaagcggaatccaaattgataacggacgaataagatcacaatgaggagaatgagaaagtttaaaatgttttcttcatttcgcacctgtgatttcatttcctttacaataagtgaccatttttttgaagaagaaaatggcagcttgtttaaaaaggttaacgcttttttttctgccataatcggcatcatcgcaagagaaagaaaggcgccgcccgccgataaaaggataaacagaatcaaaattacatagtttaccccttcaggagacattccttgagccgctaagaaaaacggtgctgtaaaatacatcaaatgataatcaaactgtatatatgattgctgaatttggctgatatcaaagtgcgtcattccatacgccacaactagtgctaataaaacaaagatcgctgcaaatttttgcaacggtaattttaatttcagtacgaccaaataggtcatattataaatgagctgtaaaagcattaagacaaaaagcgattgcaaaatcaccatcaaaaagaacgtaaagataaagaaaatacctattccctgggcaataaaattaggtagcagcagaataccgataaaaaataaaacaagccctgccaccactgtcaccatcgggataaagtatccaaggcttttctgaaaggtagaaagcgggaaccagctgagctgcatagaaaaacggtcttgctcaggcgttctgaccttgatcaaaatgaataataggcttgtaaagatggatgcattgatcgccattgatacaacaagtaatccaagtgaacgttcatttccatttaagaaagccttcataaagacccccgtaaaactatatccgatgatggcgcccattgtgacggcaaataaaaagaataagatcacaataattcgcttcgtctgagtatcaaagagcttatacatctcctgctgccacattttaagcatcattctagaaatgattaatgatttcatcaaaatgtgcacccctatcacttaacattgaagctttcagaaacacctgttccaatgtgcttgattgatatttctcctttaaggctgagaccgttccttcatccattttatttcctttagaaataatggcgattttgtggcacagctcttccgctgaaagcatatcatgcgttgaaagcaagatcgcaccatggtgctcggcataacgcttcatcagtttctttgtgtttataaccgcttcaatatcaagtcctctaaagggctcatccatgatcaccaattgactatcaagcataaaggcggcaatcagctgtgtcttttttttcataccatgtgaataggtttcaatcggtcttgataaagccgagtccatatcaaacagttcaattagttgatttcttctatgaattgttttacattcatacatagaagaaacaaaatctaaatattcagcaccagtcaatgcttcaggaagcagcaggtcatctggaacataggctacttgttttttaaaggatggttcgtcatttgtctcgtcctgcaacagaatcgttccttctgtatgcttaatgatgccgagtatacagttaatcatcgttgttttaccggaaccattcggtccagcaacagcaacgatttgatgaggggcgatctttaaatgaaaatcattgacagcagtcacgttatttttatacgtcttggttaatttctcgatcgtaaacatataacctccaagtgtctgcatattctttaaaaacagatcaggctaaaccgcccgccacagacggtttagccctggtgtcatttcatagaagtaaaaagatgaatcctaagtatagctacttacattcaatttggacttttaagccactttcccactgaacggctcctgtaaagctacccttgccgtttgctaaacaccaaactgctgctcctagaacaactgttgctcccaatccaagaaggacagcaacaaatactaagaaccaagcttggtccataatagcaggttccatagtggaatagtcaacttgcggcgctgcataagtcatacttttcacctcccagcttatgatgatcgtatcataggcttcactctccaaacatcaacagaagatcccatttttgaccaaacgtactttcgagtaaaatgtgactttttattcaattcttcacttttaagtgtagaaaccctatcttattatctagattttcccaccccttaagaaccacaaaacccatataatggcaatgaaaccatcttttttctcccttttttgaaatagtccttatttatcaatccctttatatatgctttcttttttgtgaaatagaaagaattcccccgatatatcagataaaaaagtcctgattatatgtcgttaaaacactatttatgaaatatttactgataattccgacaaaagagtgagcctattttccttcttctcttgtcacttaaaatatgtatatacaagaaagcccattgggaaaaaagccctttcttttcttgagtaacatccaacatatgattcgcttctttctatgataaagcaacttacagcataggcattccaatgacttcactagctgtactgctttcaaaaaaaactgatccgtactctctaataacacaatctctcttttcctcagcatatctacaccctttctcattgaaataaaaaaagcccatcaactttattgattattttttcagatttatctaaaaaatgattgaccaagcatgaaacaagttttatagtcatattaaatatttcttatcaaagtagttggttttatctaacaaaaggaggatacacacatgtcagaagaacgtccattccgtttagaaacaaaagccattcacgcaggtcaggagcttgattcagcaacctattcaagagccgttcctatttaccaaacaagctctttcggttttagagatagtgagcatgctgcgaatttattcggactgcaggaacccggaaatatttattctcgcattatgaaccctacaaatgacgtctttgaaaaacggatcgccgagcttgagggcggcattggtgcactcgctgtctcttctggacaagcagcgaccacttattctattttaaacatcgcaggagctggtgacgaaattgtctcctccagcagcctatatggaggcacgtacaatttatttgctcatacactcaaaaaactcggtattacagtgaaatttgttgattcatccaatttagaagaactcgaagcagcgattacagacaaaacgaaggcagtgtatgcagaaagcattgggaatcctaaaggcgacattctacatattgaagccatctcagccattgcacacaagcaccatattccgcttattgtggataatacactcgcaagtccttatttattaagaccgattgagtttggtgcagacattgttgtccattccgctacgaaattcattggcggtcatggtacatcaattggcggtgtcattgtggatagcggcaagtttccttgggacgacagtgataagttcaaagggctgactgaaccagatccaagttatcacggcctcacatataccgaagcaattggagaagcggcttatattacaaaagcacgtgtacagctcttacgtgatttaggagcagccttgtcacctttcaactcatttttacttctccaaggcttagaaactttgcatctgcgtctcgagcgacatagtgaaaatgcgttaaaaacagcgcaattcttacaagatcatcctctagtagattgggtaagctacccaggacttgaaagccatgaatcttatgagcttgctaaaacctatttaccaaaaggacaaggcgccattctcacatttggtattagaggtggacgagaagctggtaaaaagctcattgattctgttaagctgttctcacaccttgcaaatgtgggcgattctaaatcactgattattcatcctgccagcacaacgcatcagcaattaagtgaagcagaacaaaaagcgacaggtgtcacaccagagcttattcgtttatctgtcggaacagaagcgattgaagacattattgcagatcttgaacaggcgatcacaaaaagccaggctgaatgaaatagaaaaagcacacctcagtgtgctttttttatgtgtcattaatcattaagtagtcgaatgtcttggaaaggataaaacacaaatgaagtcgttccttgaatatcactctttgtaaaaagacctaagccattgcggctgtccattgagttttgacgattgtcacccatgacaaaatacttgccttttggaacggtaagagggccaaaatcaggtgtcagcaaggtcccatctgcagctgctttctttttgtttgacgctaagtaaggctctgccactttttgaccattgacatatagctggtcatttttcatttcaattttatcaccaggtaaaccaatcaaccgtttaacataatgagtgctgcggtcttccccatcaagaacaatgatctgtccccgcttgtaatcaccgaagtaatcaactgttttattcacaaaaacccgttctgtatcatgcaatgttgggtacatggaagaccctttgacaatgtacggtgcgaataaaaagttacggatgataaaaacagcgatgaatgcgattaagatcgctttaagccagctccatacttctgatttctttttttgtgttgttgtatttgttgtcataagctcctcctgaaatcccctaggacgaaatgcgttacaccagctacacgccagcatcacgcttgtatcaccctaaatataaacatattttgccaacaaatcaagcgatgagagagaaaaaggcaagcacccttctgtgcttgcccaaaactcagttacttagcagaagaatcatcttctttttcttttgatttaccatagaaataatcagatggattcactggtttaaaatcagacagcttgtggaatcgaagaagatccctataaagcactttatctgataggcttaactgattatcgacacgggctttaattgcctctgtctttttattttgtttcacaactttacctgtttttgtatcatagacagtgttatctacaagtgtatattttggtgtcacatagtttccgttacggaatgcaacagtttgatcatgcttcttagagaatagatctgttccaaaatttacatactcatttgaatcaataccttgtaagtgaagaagcgtaggcatcacgtctacttcaccaccatacgtatggttcacgccgccctgtttgccaggaatacgaatcatgagtggtacacgctggttttgcgcattttgataaggtgtaatttctttcccttgaatttcgctcattgcacggttatggttttcagaaataccgttgtgatcaccatataataaaatgacagagtctttatacatacctgattttttcaagtctttaaagaattgctctaatgattcatctagatatcttgctgtttggaagtagttatctactgttttgtcaccagttgttgccttagcaatcgtcgcatctttttcatctaaattaaatggatagtgattagtcaatgtcattaaatgtgcataaaatggctttttcattgattctagcatcgggattgattctttgaagaatggtttatccttcagacccatattcacaaaattttcttcatccatgttgtaatatgaagcatcgaagaattgatcatatcccatatgcttataaatcgtgtcacggttccagaaagatttatagtccccgtgaagcactgcgctcgtatagcctgctttttgatctaggatggcagggagtgattggtaagtgttttcaccttttgttacaaacgctgctccctctggcaagccgaacatactattatccatcatcagttcagcatcagctgtttttccttgacctgtctgatggaagaagttatcgaaatacgtaaagtcctctttcccatgagccagcttatttaaaaacggtgtcacttcttctccatttagtttgtagtcaattaagaaagactggaagctttctaaatggattttaatgatgtttttcccttttgctttaccgaaatactctgcgtttggcttcgcatagtgagaagctgtatagtttacaacatctgttaaatcttcactgctcgcatttgctacctgtgttgcattttgtgctgattgtactccgtcataaatcgtataattataaacacctaaatatttaacaacatacttatgatcaaatgttcttgttaacaattctggacggtccttttcagctaaatgaaggtttacgaagaacagtcctacacctgcagccacaatcagcagtgcaaatgtctttttcatttggaatttcttcacttctggtctccaaatcacaatcgcaatcaagatcataatatcaaggaaatacaaaaggtcatgcggcttaatactagataacacaccgccagtcatgcctcctccaagattgcctgcttgcttcattgtggagaaagtcaaaaagtcatcaaagaaacggtagtacgctacattcgcatataaaagtgcggtcataataaagtcaatcacaattaaaacaatggcagatttacgacccttcaaaaagagagccagtcccaaaaacacaatggctgaactaaatggatttaataaaagaagaccctcttgaaaagaacctttcactcctaaattaaagtccattttgtaggctgcatacgatttcgcccaaaataaaaggacagccaatacaaaaaagctatatttgttcgcaaatatttttttcataaaacctcttctttcttattatcgttctgatataaatgaaatcataaaaaatttacattgattttgcaaatgtaaatcttcttcaccaagcattccgatgctctgtttccgccggatatgtgtgctcctctaatataacgtatgagaagcattataggtttcaaaaaaaatacgagtaaataaaaggaaaaatatccatttacattttatttacacacactttgcaattcaatggatgaagaagggtttgtaaatcactcagtactactttacttttttcatctattcgtgtcaaagtaattataaagaaaaggaagaatcacctaggtctttcgactctttcacctaaatttatacaaaatttgataacttccagccatccatgtattttctctccttctaacaatctaaaaaagttttaagcaaaaaaagcttgatttctcctcctcatatgcggtgtgataaagatatagattttcaacaaatcaggctggaggacatcacatgaaacataacaaacaaataaacgcatttgaagaacgattttcagaagaaatagaccacatcattgctgtcacaggaccctcaggagtaggtgcaggaaaagccggacaggaatctctttggaccgcttctattccactgattgcatggaaagataaagacctcatcacaacagaaaacataagactctgctggttaacagatgaagagggattaagggaaaagcagacacaattacataaagaatcaatcgtgacacttcaggtccgaaaaggcgaaggtgagttcatgcttgtatcactcatcgatacagatacacaggatgaagagctgcaagtgatactagaagaagcccaaaaacctgttttttttcatgatgacatgctgggtacctttgaattagtgaaaggactagacttatttgaaacaacgatccagtggagtaatgaagagtgcctgctctacttcaacctcgaagaagatgaaaaagtaaacgactctcttcgaaccgctagacaactcatgaaagagcagactacatgggatgcttctattaaatcatttgcagcaaatcagctgcttgaactagctaaagactggcaggcacaagatgactccgctgaaacacaagaagtacttacgctggatcactttataagccgaatctcactcgaaagcttgcatgcctacccagatggagagtttgaggtctactgtcatgacggtgatttgttttggggacatgtcattattgtctctggcaatatcaatggcacctttcaagatgcccacattgcaggctaacaattggaggggtaagtaatggagttcaaagcttttcatgaattaaaacaattagggaaaacacccatcgtggctaagattggtggctttcgtcctgatccagcagcatacagctggtttgccggtcatttcttcatccaccctgatcaaggctggcccatagatcaagatggtgccatgattccaatcttacaaattcatttacctgaagtgccaggaggattaaacggattcaatgaatgtcaattgattcaaatctttctcaatcagaaagcacttccgatggatatcacaaaaaacggcgaagggtggaaactcattgaatattcaactatggatggattagaagtagttgagactcccgaagaagtgagaggactaaaaccctttcaaatccaatggaacgaaaatgagcaaaaggacttcccctgctgggaagaagcttggtcatatgttgatttatcagaagtgaatgaaagtgatgaagcgacagaacacttctttgatcaatacacccattattcgttcacaaaaatcggtggatatggagcatatattcaatccccaccccatcatcaaccaggcgagttcatgctgcaaatcgcctcagaagaaaaacctcggtttatgattggggataacggcacgatgtatttctattacgacaaagacacaaaagaatggtttatgcattgggattgtttttaacgttgtattgaatgaaaccttccctccttctaagcgtaggaaataatatggaaggaggaaccaacatgggattcatttttgatatcttctcactagctgtgtatattccttttctacaggtagatgaagaggatatctctagcaacgaaggcgagctcaaaaagtatagctggtttcatgcattattaaatgatccagcttacagacaccttatcatttatcatccagatgttagacacgtcattggcagatgtcacacagataaactccatcgcaagcgatgcaacttaaaatgcgaacgtaaattgctgaaagctttacgtcgtgctatgtaaatatacaaaaagagccgcactatcctatgtggctcttttcatatatccttttgaagaaaacatttgacgcctggacaactctccccgtatattatgtataaatccatctttttcatagaaaagggggcttcacatgcgcttgtttaattattggaaaaaaaagcagccaagacagcaggtcaccactgaaaaacaggaagacagcatcccaatcaacttctccgcacttccctttggctcagacaccatagatgattttttgttcaacttagaccttacctcgaagctcacagatccctataaagaaacagacccgaacaaatgaacctatcctcatccaatcccggatgatttttttatattcgatgaaaggtgtggcccatgaaaacatattatatcgcgagacactgccaagcaaatggacaatccgaggatgcgtctttaacgccacaaggcatcgcacaatctcacgcactagcagagttctttaatggcattcacctcaatcagatcatctcaagtccctataagcgagcactccaaactgctgatcctcttgctcatgcaaaacaactcgaggtaaaaattgatcaacgtctcgctgaacgtgtgctaagtagcaaaccaatggacgattggtacgagaaactaaagctcagttttacggacttacattcgacttgtgagggcggagaatcaagcctcgaagccatgaaccgcattgtagaattactctacgaacaaataaattcagaaaacgatcataccctatttgttacacatggtaatcttatgagcctgcttcttaaacatgtcgatcccatgattggattcaaagagtgggagaaactaagcaatccagatgtctatgtcctgaaatatgttaaaccagatcatatagaaatagagcgaatatggcataaataaacggcagaatgaattctgccgtttccttatctattgttgataataaaaagcctctacccactcatacggcttcttacgctccgcacaccatttcatgaagcctcttgtctccgtttgctgaaatttcttccagtctgataaaagccgatcataataggctacttgtttttcaacattagtgcgaattctcttatcttcgatcagcatcatgacatcttcaataccttgaattcgctcttggtctttctcatagatgctcaaataaagatcttcatgtatatgatgaaacgaataccataaagacgataaataggtttcgcatatttgaacaatgacacgttgctctttgctgcctccaagctctagtgccttcaataaatagggcagcccttctccccgatgcacaaacaagccctgccagcgatacggcctcacatccatcggatcaactttctcccactcttgcagaacaggctgaatcaccccaatgatcaatggatatacaagcaaatgatgtccatcctcaaaccgttcaatcttttcaaacagccaagcaacaaatgaacgccgtgctgcaaattcgttctccttcatttcttcaacaaaagtctgaagaacctttaacgcatctttacgcagaccctgttctttcttcacacagtactgtctaaaaagcggaaaatcatgggatccctcgtcttcaatgatggtctgtaatatcgtcttcatttgcaagttaacaactccgcctttttacatttattctatttctcatttatctttgaatcataaatctgattccttaacgctgatttacccattctaaataacgcctttgaatcacttttttgattttatcgtagttctcccaactatctttaacataatatacgccttcagcttctggaaatgtctcctcgtagtcatctaaatataaaccattatcaaaatcgaaatattcttgggtaaattcatttccctcatcattcagcatatcatttgaaaacacaccatcacagtccatatagatttgagtccctgtcacttctcgtgatttaaatttttgaatttcaccctcaatgtcttcttcaaattcttcactgaacaaatcattatcaatgatccaccccaaaaacatgcctgtatgtacaaaggcttgatcaatagataagtcctttggaaactccccatcataatgatattttgctttatcataaacgactacttcaaacagcatttcctgctcccttcatttcttctctatttcaaaaataactttaggtctaggtaaagtcaatcttatttaagcgtgattagagtggtataaacacctaattgttctttcgctttagaaagcccctagtatccctcaaacccattcttttctatgttcatgaatgaattgtatgtctttttgataatgctcaaggtgcccctcatcaatcattttttgaaaagctatatccccgtcactcgcttttcgtttcatgtactgacataacccttttaaacgcagcagcaccatctccacataatcttctgctatttcctcaccataagcttcaaaaaacagtttgaccctatactttatatggcctgcatgttctattgaatgataattcacgatctcccccttttcagtgcgaaaaaatctactgagaggcacacatgtataaagggtataagcgatatcccaaagtcttggaccaggagcagctacatcaaaatcaatgattcccactggctttttatctttgaaaatgatgttgtacatcgcaaaatcattatggcacacaacctctatgttgttaggcgtattgtccattcgttcccaatcgtctgaaatgggaaaatcacaaacagcatcatgatacagtctaagcattctcgctatttcttttaaggcatggtgagagcacatgtattcttttaaaggatcatgaccagctacgccttcaatgaaggacaagatctctctaccttgttcatcaacccctaaaaactttggagcataggagaaattctttttttctaaatgctttagcagctttcgtgtattgatattgtctgaatttacttctcgacgaaccgtatctcccgaacgatatacgttcgagacatttccacctgtcaataactcctcatgatcattttgttttttcataaattctcccctcaaactgggtcacaatgatgatgtcagctaaagatgtgtatgtacccacaaatattcatttagttatacaaaggtagtacactgttttatgtgaatgtgctgcctcattttgtatccttacatggttaaatgtatcttatcaaatgttgcaaatcatctaaagattattctgctaaaagaagtacatgctcattcttttctaataggtttctattttttatctaaataactcatttaaaccacaaaaaaacgtttcaccacgagggtgaaacgttagattgacgggaaaaaccaatcatgaaattattaatagataccggtggccggggtctaaccggcactccgagataaattattccaaaaaggcaaggtataccctcttcaagtaaagcacccgttaatgaaataaaaattaaagttcttcttgatatatttttgattttatcggctttaaactcaaaggaattttaaactcatgaatactttcaatatgattaaaaaaatgttctatatcgtcataatccattgaccattcttctaccacctttaacttttttaactcgtttgttggtttaaataaaaattcacagtgtagttgttccatgtgagaataatcatcttcttcataaactgtaaactgacgtagaaagtcaaaatgaaatagttcctctcctgtaaaatcatagaaaccacactgaaataaaatttctttatcttcttcgctctcaactgtctcttttgaaaaagccttaaatgtttcccaaaccttttttatatcatcggtatcttcaccaatgctatctttaagataactttcagcatttttaaccgtaatcatttcaacacctcttatgtacaatttatccaatccttcttcaattagcctgcccctttattttaataataaggtaactatcaataaagtaaaagtcaatctccttagaatggcccctcagtaacaaccattttttatcatctaatgcacttaaactggtatgtatatttttcaagtactagacgaggggattatataggggtgcctccccatggtggggtactgtgggcttactgtggttcggtgctaatttcacagggtactagtgtcctcttataaaaaacaaataaaaaacgccctcctacagtttgtagaaagacgtttaaacgttgatattccttaattcttctgtaatggacgataataaagaatatctaaaattagataccggtggccggggtcgaaccggcactccgtgaggaacacgattttgagtcgtgcgcgtctgccaattccgccacaccggcatgatcattaaagagcgcaacttatgataaaaaacatggtgccgagggccggacttgaaccggcacggtagtcacctaccgcaggattttaagtcctgtgtgtctgccaattccaccaccccggcagtcttttcaaaaaggcgacacccggatttgaaccggggataaaggttttgcagacctctgccttaccacttggctatgccgccattattggagcggaagacgggattcgaacccgcgacccccaccttggcaaggtggtgttctaccactgaactacttccgcaaatcaactgggctagctggattcgaaccaacgcatgacggagtcaaagtccgttgccttaccgcttggctatagcccaataataaaatggggcgattgatgggaatcgaacccacgagtgccagagccacaatctggtgcgttaaccacttcgccacaaccgccatagatgttatgaatcatattaagaaaattggcaggggcagtaggaatcgaacccacaccggaggttttggagacctctgttctacctttaaactatgcccctatgaaaataaaaatggtggaggggggcggattcgaaccgccgaacccggagggagcggatttacagtccgccgcgtttagccacttcgctacccctccacatttgaaaaacagtgccggcaagaggacttgaacccccaacctactgattacaagtcagttgctctaccaattgagctacaccggcaaatagtgtcgtctctcagaggcgactttcttaatataacatttcgacgctgtgtgcgtcaagtgttttttagaatttctttttgtcagcttttctcttttcaaagcaacttggttgctcattagcgacgtataataatataccatcataatattcaggcgtcaatatcttttttcacaaaatatcctcgatggtagattttttgcccctttgtctcaatcggctccacttggacaattcctttttccacaaagaaatcaatcatgacgctaaggtcaggcgtgaaatacttgaggtcaggatgcgcgagcagctcgccaaaaagccatatatcttgctgttccatgacatgacgcaaatgagcggcaccaatttctgcttttgaatggatcaaaaagtcatttgctaaaaataaaagttccaaacgcttatgaaggctttcgtggctttcaatgagttctgaataaagtttataaacttccggttccatatgtcgcacctgattccaaactgtcacttctggatggaagcctttatcgattacttcaatacgtgccaaatgatgcagcgcatgcacaattgaattatatgcatcaaggaattgatttgactcaaaaaatgcttttccttctatatatctgcgaattagcttgccgtattctaaaccgattttaagtttgcggtttgaaaatgggaatgtactcaggtcatcaattaagttaaaaatatattcatttcggtcaaataggactttcccattcaaaatccaatcaatgattcggcggttcgtgccaagggtaatccattccttcaactgctcatctgtgacaacatttaaagaagctgtttggtgatcggattcatagtgcttgataaataacggctcttccgcttcttttacaatgactagaagtgctgcatcaaagttatccgtctcagaagataccttgtgtcttctttctactataatcacagccaatgtgtctggatgacttgctctctcttgataaataggacggagaagattttccatagtgattcctccaatactcgggtgtaaagttcttctctaatgctatgtatttctcctcatagaatcaaaattccttcaattcaagaaaaaagatcattgaaccattataagcaatttattcacaaaactctataactaattcaaacggaaaggtaaaatgtgctatattggagacaagggggactagggatggcgaaatactccagtaagattaataaaatcagaacatttgcacttagtttggtttttgttggctttctgatcatgtatatcggtgtgttcttcaaggaatcgatttggctgtcgactttctttatgctgctcggcgtcttatcgatcggattgagtacagtggtttacttttggatcggtatgctttctacgaaggcagtccgtgtcgtatgtccaggctgtgagaaggaaacaaaagtgcttggacgggtggacatgtgcatgcattgcagagagccgcttacactcgatccagcattagaaggcaaagagtttgatgaatcctacaatcgaaaaaagtcataaaaaaagctgaccatttaaccggtcagctttttcattaatgattttcttttttcgcacattcttgacaagtcccatagatctccaagcgatgatgactgactttaaagcccgtcacatgggatgcaagctgttcaacttcatcaaggccaggataatgaaagtccactatttttccgcagttttcacaaatcgcatggtaatggtcagatgtcgcaaaatcaaatcggcttgaggaatcaccgtacgttaattcctttactaatccagattcccggaagactcgtaaattgttgtaaaccgttgcgacactcatatttggaaatttaccttcaagtgctttatatatatcgtccgcggttgggtgagtcatagaatttacgagaaactccaagatggcatggcgctgcggagtaattcgaacaccggtttcttttaaagcatctaaagcgtcttttagttcgtgagcagccatttcatcatgcacctctcttcaaaaatattcttatattataatctttataaatagtgtacccccagagccgaatctttgtcaattacaatcctcttttttacctattcttcttcacaaaaaagaccggcatgtgtgccggtcctatcctgtgatgatattaagcgtgagcttttagttcctcaagcgcttcttctacgtggtctttcaccttaacttttctccactctttcacaagcgttccttctttattaataagaaacgttgaacgttcgatgcccatgtattctttgccaaagttctttttcagcttccatactccaaaggcttcagacaatttctgttcatcgtctacaagaagtaagaacggtaaatcatgtttttctttaaacttttgatgcttgtcctgactgtctgggcttacgccgataatgacagcatctaattctgcaaagctttgatggcgatcgcggaaatcacatgcttctgttgtacagccgggtgtcatatcttttggataaaaataaaggacaatatgttttcctttaaagtcagaaagctttactttctccccgttgtcaccggttaattcgatttcaggtacttgctggcctacttcgattgtcatgacacaatccctccaacctattttttaaatagcctatccaattttgagaggatattcaactaaggacgcttgcattggcatgttaaaataatgatagacgacgtgatacgttgagataggaggctatttatgaaattcacagaatcagaaaaattacatcaagaggcgctggagcatattgttggaggtgtcaacagcccctctcgttcatataaggcagtaggcggcggttcacccgtggctatggaaaaaggagaaggcgcttatttttgggatcttgacggtaatcgctatatcgattatctagcagcatacggccccattattacaggacatgcccaccctcatattacaaaagcgattacaaaagcggctgaatcaggcgttctttacggaacgccaacgaagcatgaagtcacttttgctaaaatgctgaaggaagccatgcctgctttggacaaagttcgctttgtcaattcaggtactgaagcggtgatgacaacgattcgtgtggcacgtgcatatacaggcagaacaaagatcattaagtttgccgggtgctatcacggtcactctgatcttgtacttgttgcagctggctctggtccttccactttaggaacccctgattcagcaggcgttcctaagagcatcgccaatgaagtcattaccgttccatttaatgatattgacagctacaaagaagcattgggtcgatggggcgatgaagtcgcagctgtccttgtcgagccaattgtcgggaacttcggcatcgtagaacctaaggacggtttcctgcaacaagtcaatgacctcactcatgaaaagggcgcacttgtgatctatgatgaagtaattacagctttccgctttatgtacggaggcgcacaggacttgcttcaagtaaaacctgacctcactgcattaggaaaaatcattggcggcggacttccgatcggtgcttatggcggtaaaaaagaaattatggagcaagtcgctcctcttggaccggcctatcaagctggcacgatggcaggaaatcctgcatccattctttctggtattgcctgcttggaagtgttaaaacaagatggtgtttacgagcgtctagatcagcttggcgctatgctagaagaaggtattttagcccatgcaaaaaaacatcaagtagatattacagtgaaccgcttaaaaggggctcttactgtctacttcacaaaagaaaccattgtgaactatgagcaggctgaaaatacggatggcgaaatgttcgcccgcttctttaaattaatgctttcgcaagggattaacctcgctccttctaaatatgaagcttggttcttaacgatcgcacatactgaaaaagatatttctgagacgctacaagcagtagatcatgcgtttgaacagttgaaacaatcataatacggtcaaaaacaggcgtaaaaaaatgcgcctgtttttttatttatcagctcttgtttgtcaaaagcgtgtgaatctgttacatttcttctcaataccttcttttgatgttttcatgaactttcaaaaatcacttgaatatttcggaagaccgctgtatattacttagttgttcatcaaaatatttataataaatgacgagtgatcatctattatctaaaagaaaggaatgcagggacaaaaccaatgaaacttggagcccgtattttaaaaaccggtattgccattgtactcgcgctttacctggcaacatggcttgggttgccaacgcccgtcttcgcgggaattgcagctgtatttgctatccagccatctatttatcgatcttttttaacgattattgatcaagtgcaagccaatattatcggagcagcacttgccattacgttcggtttgctttttggcactggaccagtcattatcggtttaaccgccgtcatggtcatcgccattaatttaaagctgaagattgaacacacgattccaattgcacttgtaaccgtcattgcgattttagaaagtgcaggggatcatttcctttcctttgccttaattcgaacagctactgtggtgttaggagttctttcttcatttttagtgaatttaatcttcctgccgccaaagtatgaaacaaagcttgttcatcacattatggaaaatacggaggagattttaaaatggatccgtctgagctccagacagtctactgatcattccactttaaaggatgacatcgatcaaataaaagaacgcatgatcaaattagatcacatttacttgttatacaaagaggaacgaagctatttaaagaaaacaacctatgtaaaatcaagaaagctcgttttgtttagacaggccattatggcatcgaatcgcgctctttacttgctgaaaaagcttcataaattagaaaatgaaattcatttgatgccagagcatttcagagaaagcttaacagatgaaattgattacttactgtattggcatgagcgcaccttgatgaaattcgtcggtaaaatgaaaccgcaggacgatgaatttcaaaatgaatgctctcttcgtcttgaaacgttaacgaaatcatttatccagcatcagcaaaaccaagaaaatgacttgctcgattacaatatgctaaatgttatgtccagcatcatcgaataccgtgatgaactagagcatttagatacattgattacaagcttccagacgtatcacccaaaagacagtgaaattgagacagaagaaaaagaagcatagacagaaaagaccgattccaagaatcggtcttattttattttcttcattttaggatccagtgtgtctcgtaatccatctcccatcaggttaaaacctaaaactgtcagcatgatcgcgacacctgggaaaattaatgtccaaggggcttgaacgagataaggtctcgcatcggcaagcattttcccccactctgggcttggtgcctgtgcacctaatcctaaaaaacctaaagctgctgcctcaataatcgctgttccgatcgcaagcgtcgcctgtacgatgaccggcaccatactatttggcagaatgtgacgcagcacgatgcggcggtgtgacatcccaaccgcctttgctgctagcacgtattcttcttgtttaatactcagcacttttgaacgaacgagccgtccaaaggttgggacattaataatcgcaatggcaataagggcattttgtaaggaggggcctaagatggagacgatcgcaatcgccagtagaatactaggaaaagcgagtaaaatatcaaacactctcgagatcacagcatctagcactctaccgccatagcctgcaatcaatccaagcagtgtgcctaaaatgacagacccgagaaccgagaagaaaccaacccataaggaaattcgcgcgccatgcacaactcttgagaatatatctctgccgaaatcatctgtaccaaaccagtgcgcagctgatggtgcactaaatcgctcaccgagagattgttcattgattccaaaaggagcaatgagcggtgcgaatattgctaagatcagaaataaaaagacaatcacactgccaatgaccgccagcttgtgctgaaagaacagcttcatcgattcaagaatcaatgattgagagcgttcttcttttggttgaggtggttcaagctctttttgtgcttccatgtgatcactctccctccctaatatttaatccttggatcaatgaccgcatacaagatatccacaatgaagttgatcaggacaaatatgagcgcaacaacgagaatgccagtttgaatgactgggtaatcacgatagctgatggcgtcatatatataccgcccaatgcccggccatgcaaaaatggtctctgttaaaatggctccgcctagcaagaggcctgtctgaagaccaataatcgtcaagatcggaataagcgcatttttcaacccatgctgataaatgatgaaaaatgaacgtactccttttgcttttgctgttcgaataaaatctgaatgaagcacttccagcatacttgcccttgttatcctcgcaataatcgcagcaggaattgtggcaagtgctgtacttggtaagatcaaatgcttgatgctgtcagtgaattgatcaaaccggccttgcaaaagcgtgtccagtgtatgaatataggtgattgactccactggatttctgacgttttcacggcccgttgtcggtaaaatccctaattcaattgaaaacagccactgccccattaagcctaaccagaaaatcggcatggacactccaatgagtgcaataaacatcgcgacataatcaaagaaagaatgcttaaaccaagcactgatgattccggcatttacccccacaacgatcgccagcaccatggcaaaaaaggttaattctaacgtcgcaaataagtatggtttcatttcctgggcaatagccgctcctgttcgtatcgaagtccctaaatctccttttaaaaggcccagcatgtaatgtccgtattgaacataccaaggctgatttaaaccgagctggatggttaactgttctactgcttctttcgttgcccgctgtcctaagataacctgtgctgggttccctggaataaaccgtataattgaaaacacgaccaatgtcattccgatcaatactgggatgagcattcctgcccgcttcatacaataagcaaacaaacagctttcaccgccttttctttgtttgaataagggagatacaagatctcccttatttgcttattcgaaatacacgtcagtcaaagcttctgaaccagttggatgcggctggtagccttttaaatcactagatgctgcaagcattgggatcgaatgcaccaatggaatccaaggtgcttcatcatgaatgatttcctgcgctttttgatatagctcatttcgtttcttttgatctgtctctgtttgcgcttcaatgaggatgtcgtgcattttatcgttttcgaagaaagtatagttgttgccgccaatgctgtctttgtccaaaagtgtgtagatgaaattatcaggatcgccattgtcccctgtccagcctaacaagaacacatccgcttctcctttacttgccttatctaaataggtcgcccagtcatatgtcacaatttctgctttgacgccgaccttttcaaaatttgactgaatgacttctgctaccttcattccatctggcatatatggacgtggtacaggcattgcccaaagcttgatgcgaaagccgtcagggaagcccgcttcttttaatagttctttcgctttttctggatcatatggatatggctcaatgtcgtcattgtagccttctaaagcaggcggcaatggattttttgctggctcagccagtccgctataaaatgactcaataatcgattctttatcgaccgcataattgagtgcctgacgaaccagcttgttatcaagcggctttcttgtgacagtcagtccgatatagcctacgttcattgatggtctttcaatgagctggagtgctttatccgttttaatgccatctaaatctgacggattcacaccatccatcaaatcgatttcgcctgttttcaaggcatttaagcgagccgagttttctgggatcgagcggaagatgatttgattcagttttggtttatctttctgccagtaatcttcgttcttttctaatacgatacggtcgttttgtttccactctttaaacttaaatggtcctgttcctactggattctcgcgaaaggagtcgccgcttttttcaacagccgcaggacttgcgatgccaaacggtgacatggcaatgtttttaagaaatgtcgcctgcggtcgctttagctgaaattctacttcatgctcacctttgacgatgatgtctttaatgacatgtcctttatcttttttatagccgccaaacatgccatagtaaggaaatttttctgcatcaccattcatccagcggtcaaagttgaatttcactgcttctgcgttaaagtctgtgccatcgtgaaatttcacaccttctcttaagtagaatgtgtatgattttccgtcctttgcaacatcccagtctgttgcgagacctgggtggatggtcgtgtctttctcaccgtaattcaggagcttttcaaacatattctctgtgaccttgaaggtttcgccttctgttgttgtgattggatcaagtgaagtggagtctcctcctctgccaaatacgagagtgtcttttgttgccttctcttctgatgacggagcggacgagcatccccccaaaaatagtgcaagcacgagcacaaaaatgaaactactgaacaaccaagtcttcttcattgtgttcctccttttggtataagtaacacgccgccgcatgccccggctcctcctcatacaaagcaggtgctgctttcaagcatttctcccacctttttggacaccttttgtagaaaggacaaccgccgcttggcgtcattgcagactcttctgccgacacatcttgcgtctctagcacgtgatccatatgtggaatggatttcagaagcagcgatgtataaggatgaagcgggctgtgaaatacgtcttcggcaggccccatctcgacaatgcgtccagcatacatgacggcgattcggtcgctcatatacctgacaacgccaagatcgtgagaaataaatagaaacgtcagagaaagcgtcttttgcaattcaagcatcaaatttaaaatttgcgcttgaacggatacatctaaagctgaaaccggttcatcggcaatgacaagacttggatgggtaatgagtgctctagcgatcccaatacgctgcctttgtccgccgctaaattggtgcgcataacgctccccgtaggagggatcaaaaccgacaatatgcagcatctctttgacccgcttccgtctttctgctttcgtcccatgtcgatgaacaatgagcggttcctctaaaatatctttgattttcatacgtggatttaatgaagcatatggatcttgaaaaatcatttgaatgtcttttcttaaagaacgcatctctctttctttcaaaagagtgacctcttgccctttcagttgaatagagcctgacgtcggttcagttaatctcattaagcttttgccaagtgttgatttcccgcagcctgattcaccgacaatgccaagcgtttccccctccttcacgtgaaaggacacttgatttaaagccaaagtcgattgtttatgtttagaaaaaaaagcggctgtgtcataccgttttgtcagccgattcacttgcaagagtgggtgactcagtgtcttctcctccttccattagaaagcacgccacgcggtgatcctgttcaatggattgtaaaacggggtcttcttcaagacattgcgccatttgataggggcagcgcgcggcaaattgacagccggatcgaatggtccctggcttcggtacatgacctgcaatagagatgagcttttcttttttctctttgaacgatggaactgaggcgaaaagaccttttgtgtagggatgcagaggtttttgaaaaatacggtcaacggttccttcttctacgattcgaccggcatacataatcatgactcgctggcatatttgccgtacaacgcctagatcatgggtaataaataagatcgcggtgtccatctcttcgttcagctttttgagcaggcgaaggatttgcgcttggatggtcacatcaagtgcagttgttggttcatctgcgatcatgagctttgggtgacaaagcatcgccatcgcaatcatcacacgctgacgcatgccgcctgataattcatgcgggtattttttaagcaacgattcggcttgcttcaatccgacggtctgaagcagatcaaccgccttcgcttttgcttctttttgaccgattgcttgatgtgtgaaaagggcttctgtcatttgtttgccgatggtcattaatgggttcagagaggtcattggttcctggaatatcatcgaaatgtcatttcctcttatttctcgccactgtttttctgaaagcgacagcaggttttgcccttcgaattggatctctcccgttgtctctgtttgctggttcagccccattaatgacatagatgtgatacttttcccgcagccagattcgccaacaattcctaaggtttctcctttttgaatcgagaacgatatgtgatggacgatgggtactttttgctttttttgctgaaatgcaatggacagctgtttgacatctagcagcacgtcttgttctttcacatattcaccaccccgtcatactttttaaaattgtattgagacaagctgggaaatatgtcatgtttttgacaagcataaaaaagcctatccgctagaatcggataggcttctactaatttaatgtttgaatggtaaaaagatggcgatagtggctgtctttgttcattaattcttcgtgtgttcctttttccacaatctcaccttgttccatgacgacaatgaggtcagcatgtgtaattgttgataagcggtgcgcgacaataaaggttgtgcggtcctttgctagcttttgcatcgcttcttgaatgtaatgttcactttctaaatctagtgcagacgttgcttcatctaaaatcaacagcggtggattttttagaaagacccttgcaatggaaatccgttgtttttgaccccctgacagcttcacgccccgttctcctaccttcgtgtcatatccttcaggaagagacatgataaaatcatgggcatttgctgcttttgcagccgaaacgattttttcaaaagaagcttctggatctccaacggcaatgttttctttaatcgtgtcactgaataagaatgtatcctgcagcaccattccgacttgatttcgaaggcttcttgctttgtactcttttatatcaatgccgtcaatttccagtgatccgtttgtcacatcataaaatcttggaattaagctgacgagagtggacttccccccaccgctcattcctacaagcgcaaccgtttgtcctttttctactttcaaggagatgttgctgagaatctcttcctgcgtgtgttcataacgaaatgacacatttttaaattcgacctctccttttaaatgatcggcttcttttgcattcggtcgatctgttacctcgtatggctcatcaataaattcaaagatacgatccattgacgctaccgactgagttaaagtcgtggatgagtttatgaggcggcgaatcgggttgtacatccggtcaatataaccgacaaaggcaatcatggtcccgatcgaaagtgatccattaatgacggtgtagccagcaaatgcaatgattaatagcggtgcaatatcagtaatggtattgacgacggcaaatgttttggcgttccaattcgtatgattgatcgctttgtttaagaaatttttattttcatcatgaaaattctcttgttcatattcttcaatggcaaagctccgaataaccggcattccttgtacccgctcatgcaaatgcccttgcacttcagccagcgcctgtgaccgctcttttgtcagcttacgcagcctgccgtaaaaaaacttcactgcaaacgcatataacggaaaaataatgacagaaacgatggtgagcttgatgtccagtgtacacataatggcgatcacgatgagcacggtcatcaaatcaagccaaatattcataagacctgtgatgacaaactcttttgtctgctccacatcgttgatgactctagatatgatttctcctgttctcgtgttggcataataacgaaggctgagcttttgaatatgcgaaaacagcttttctcgaatatcaaataatactttactgcctgtccactgcgcatagtattgtctatagtattcaacaggcggtcgcatcactaaaaataagacgagcatgattcccataatcatcagtagagatgatgtcttttcttcagccgaccccgagccttgaatgacatcatcaatgacatactttaaaagcagaggcaatgttaagggaatcgagaacttgatcatcccgatgaccattgtcaatgcaatctgttttttatacggtgttacaaaagccatgtaacgtttaatgacccccatgtaaatctccttcccaatctatcagtgcctcttatccgtacgcaatcaaaaacctgttagcctaaaaagctaaacaggtttttgctgctcttgcttattttgtataatgtaaaaaacgttcataccacatatccacaaattcaggagcaaacggacctttccgctggtgaatccaatgcaataatgtattcagatgctctcttaagatactatcgatttcctttggataattcatctgcctcttatgatctgcatattcatcctcatccaaaatattgtacgtcatgtccggaaagactttgacatctaagtcgtaatcaatatacttaattgcttcttcatctgttgcaaaaggagagctgatgttgcagtaataatataccccatcatctctaagcatcccaatcacattaaaccattgttttgcatggaaatagcaaatagccggttctctcgtcatccaagtacggccgtcggattcagtcaccattgtccggtcgtttgcaccaatgatacacaattccgttgctttcagaatggtggtttcattccaaatcctgtggatcaagccattgtgtttatagctttgaatttggatggtttctccttccttgggatagcccatattttctcccctactttctataacaaaaaaacctaacagtccaaagacctaatttcctaactaaacatgtctctattatattataccgttacatcattaaaaaatgaaatgaaaaagccattcaacccaattgaacggcacactgtcttacatcacggttgaactcttttccatctgcttatatgaattgatgacctcttctgtctgttttgtaaacaaggtttgaactctttgcagttccacacgtttctgtttgatttgatcatgaagcctggtccactcttcttttttttcatcttgcagcaattgtttttctgtttctaagcatagatcgagttctccctgtacattgagcagttgatccatgagctgcatttgttcttttacaagctgatcgaaatcagacatctaactcctcccttttattttcatccactttttgtctgtataccatttcttgaaagatcgccgaaatcctttgactgtttatgtagaggttttacaggttttgtcggatggtggggagaggcaaaaagaaaagcacttcattcgtagatgaagtgctttctctgtttcagtgattagctgttttgttgtttgttttgctcagctttttggttatatttttttacgtgctgtgcgtcagtctcgctagcaaattcagtgccatattgaccaccttgtgcagcagcttggttttgtttcttcacttgttgtgcgtttgttttgttttgttgtttgtccatcattatcacctccacgcacattaatttgtgcagaaggtgcaaatcctattcatgatttttttaaacaagcaaagaacgtccgccatccacaataatcgtctgtcctctaatcatatctgccttgcctgatacaaggaattccacactgtcgaccatgtctttaatttccaccattcggccagctggtgtatttttcttggcgtcttctaaaagctcttctcggttcgggaagtgcttaagtgcatctgtatcgatcgcgccgccagatacggcattcacgacaatattcttttgtgacagctccacagatagataacgcgtcaatgcttctaatgctgcttttgagacgccaacaactgtgtaattttcaagatagcgaatagagcctagtgagctaatgctgacgatatgaccgccaccgtttttctccattagtttcgccgcttcttgtccgcaaaatagtaacgcttttgcattgatattcatcgtccagtcccaatgattttcttcaaggtccatgattggacgctgaacaccagatgccgcattgttcacaaatatatctaaacggccaaaggtttcgtcgatttgctgaaacatatctttaattttctctggctgacctacgttggctttgacaaccaatgttttaacacccatcgcttcaatttcttccgctgtttcaagtgcggcttttttgcttctcgcatagttaatgacaatgtcatatcctttttcagctaggcgaagggcaacttctttccctacacctctgctgctacctgtaattaatgcacatttacgttgactcattattgttcatctcctgatttgaatagttttcgtccattcgcttcacactaatagaaagttcctattaggaggttacattcatgtatgtcggacgcgatttaagccagcttggcatgatgtccaaggatcaatggaaagatactgagcttgcttactttcatcatgctttccaacaaattttaccttatttaaacgaagaagggcaatctaagtatcgagaaatcatttctgaaattgaagaccgcgggggtctgcaccgaaatgaagctgattatacccacgggacaacggttaaatacgactaggctcttcaagtgccagcttccaaattttttggtgtgagactggcaaagcatatgcctcaaattcttctgttgtgactttcttcagcatcgtgtcatcagatatagaggtaactcgtccaaagaaaacagaaatattccagatgaggtgggtaaatacatgctgaatggtgccttctaagtcaccaagctctgcttgtacacctgcctcctcttttaagaaatcaatcagctgctctttttccgtttttcttcccttcattgtttccatgtttgggaactcccataaattcgcaagcagacctgtacttggccgcttatgaatatagaggttgcctgcgtcatcaaataacaccgctgctgccattgattttgcagtcggttttttctttttgcttttcactgggagctcatgctgaacaccttcttcgagtgccgagcaatgcatgttcacaggacaaatgaggcatgcaggggatgttggggtgcaaatgagcgcaccaagctccatcagcccttgattgaattctgatggcttttcccgggaaatgagctgatcgaccgcaaactcgaaaatatttctcgtttttggttttgcaatatcatcccatatggacaaaatacgggaaatgaccctcatcacgttgccgtctaccgcagggtacggcttgttataggcgatactcagtactgcgccgctcgtatacggacctacacctttgagctttgaaaattgctctttcgtatcagggacaatgccaccgtaggattcatatacttctttcacagctgcctgtaaattacgcactcttgagtagtagccaagaccttcccatgctttcatgaccttttcttcatcagctaaagcgagatctttcaccgtcgggaattgctccataaaccggttgaagtacggaatgaccgtatctactctcgtttgctgaagcatcacttctgatacccagactctgtatggatcttgattttcacgccacggaagtgttcgttgttctttttcataccaatcaattaaatcatgctgaaatcccgcaatattgttgcggtccagcttttcttgaatgtctttcatatctatactccttctcacttgaaccgagggctaacgttctgaaaagaaccttatttgttgtatactgtttgtagatacgttaacatgttacattaaatcaagacaaagcaaaagtgcttttgcacatagtcttgaaagaaggcgtatactttgtatgattgttcctaagcatgacaactaggaggtaatcaattggatactggtactcatgtagtaatgggcatttctcttgggggacttgcacttttagatccagccgtcagcgcagatccacacatggcacatgccgtgatgatcgcgaccatcgccggctcccaagcaccagacattgatactgtgctaaaactaaaaaataatgcggtttatataagaaatcaccgaggatttacacattccattccagctgtactgttttggtcattgctaattccggctgtgattttcccatttgtgccaggggcgaatatacttcacctttggctatggaccctattagccgttgtgcttcatgtgtttgtcgatattttcaatgcatacggtacgcaggccattcgcccattttcgaagaaatgggtagcacttgggatcattaacacgtttgatccgtttatcttttttacacaccttgtcgccattgtcgtatgggcgattggcgggcatcccggctatacgttcattacgctgtatgcggtgattttttgttactatatcgtcagggtcatcatgcagcttcagatcaaacgtcagctgcgtgcacgattcgatgagattgaagacattattatttcgcctacaatgaagttcagacaatggcgcattgctgtgaaatgtaaatcctctttccatgttggacgcagtatgaatggtgagattatcattttagacacctttaaccgtgtgccggtccctgatactgagattatgaaaattgccaaacaggatgaaaacatttcagcctttctctccttctcccctgtctaccggtgggaagtagataaatacaaggatcattatgaggtacggttcattgatttgcgctaccgcagcaaaggtcattatcctttcgtcgcgatctgccatatcgacttggatcatcaaatcaaaaattcctataccggctggattttcagtgaagaaaaactgcaaaaaaaattaagactcggctctgtgtgagcgagtctttttttgttgtgtagggcttggatttagggggggaagtacattattgattattcattttgtgtagattttgaactggataggtagttgaatttgtataaaacaaagacactgtgatctatgcactcatgtagagtgcgacctgtagaagttgatattaaagcaaaagttgaaggatttcaatccacgcactcatgtagagtgcgaccataaaacaagttgctatttgccatattgtctaatttcaatccacgcactcatgtagagtgcgacaagatcgctcaaaaggtagcagaattgaaatcgggaatttcaatccacgcactcatgtagagtgcgacaaatgccctatccaatttaatggttagggcatcaatttcaatccacgcactcatgtagagtgcgactgcgatttccgccctaattataacattttttagggaatgatcgtcaaaaccctcaattttctatatagaattttgttttcacccctaaacaatatacattttttctcatctttgtcgaataaaacggtgcgaatgttccagggattttatgttcacctcacattcgcaccgaatttttctagtctgaaatctatttgaatcttgataatcatatttattatttcagcaacaactttgaactgaataaatacatgactactgagaggcagagttatgtatttcgcaattattaatctacacactcatgtaaagtgcgacgccattgaaataccagaacatagagaatcaatatttcaatccacgcacgcatgtaaagtgcgaccagtatctagaacaattggctattatgtttgtaatttcaatccacgcactcatgtagagtgcgactgtacgtcaaataactatcgactaaacgtgtggatttcaatccacgcactcatgtagagtgcgactttaaaacagacagggacgctttacagcaaataatttcaatccacgcactcatatagagtgcgactgaaggtcccaatgattattcctttgaaaaaatatttcaatccacgcactcatatagagtgcgactgcatcttcctgacttaaatgctgatccttttcaaatttcaatccacgcactcatatagagtgcgactgcgatttctgccctaattataacattttttagggaataatcgtcaaaaccctcaagtttctatatagaattttattttcccctctaaataatatacattttttctcatttttgtcgaatgaaactgtgcgaatgttccagagattttatgttcacctcacattcgcaccaagtttcatgaaatgacgtcgtccattttaagtcttccataacctgcatttgttttagcgccgattccttcgtgttctaaagcgcctagtaagatggttttggcgagttcgagccattccacttcttctggtagattcttttttgttctcaatagaagttgaaagcggccgttgaccaccgttaagaaaagaatcggtgttggtgagtcatcgtctcgaggcgctggaacacttccccctttgttcatcttatctagcttgacgctgttatagtctgaatgatgtggtgtcatcacatctactttgaatgcttcctttactgtctcaggcattatgagcgcatcatgaaattcgatgatgccagcacgttcgtttgttccaaacaatgtgttgtaatcactaccacctagttttagttctggaaagttttcacctaatacagaatgggcataatgagaggctacaccttttaaagctgttcctggtaaataaggaacgccgtatatcgggtgtaataacaaacccgtttcaagtacaccctctcctccatgtccaatgactaacggtgatatggatttgactaggcatgtggggttcgtgtcagtataatatcgctccaaaaacttttcatacaacaagcgatttttcccccattgttttcgatgtagattaatcacattttcataaaatgactgcttctttgagctgtcctttatgacgttcgacaatgtaaaaccatcaatctcccatttgcttttgtttaaggttaatgacagattcattgaatgtcctccacattttccgccccttgttccacctttaaaattgattccgcatatctttttaaccaaacagatgcacttaaagcttgtcttgatttgattaagtaatctcgattggaagctgaccaactttcttgtaaatctaaagtttcttttatatcttgaacgaattgttgataagcatttcctttttttgattttgcttcaaaaaatgtaatggtgagccttaatccatttgttaagatcattgaggcgaatctgtgacagagttgtccatattgatttgagaaattctcctcattcgttttggcattcatcacatgttgatacgctttctcagcataatgatgttgaatgagtttcatgatctctcccctcctgtcatacgccaggatactcttcctttacctacgtttgtgtttccacctaattgaagatacatctgtttttctagttgatttaacagttggtgtctaacagataaatcattgcttccatcaacacgatcacaccacatgagcccataaaatatggcttctgccggtacatactcttcataccagagagctcctttactaactgtttgggtttcatgatcaattctaatacgaggtgtcacttcagaattcatggtgacaatgtattgaaaaacgtcatcacttacaatcacaaatcgttctatccaaagagtttgtgatggtttatcgtcgaataaaagtttggccatctgttcagcaaaatcggttagttgttgagattttttcgcttccccttggaattcacctaggtataattcgtcattctctactaatttagaattcaaggtgactagcgtgcttgattcttctatgggatcagggatatccagcgatacgcctaatgcttttgcatcgcgagctaatctttttaatatgagtggacttgccacatatccaaatgtaccgtatctactcgccaccgggaatgaaaataaccggccatctgtcatgacgactgctcctgcgcttccatcttgatctccttgtgtaccaaatactttttgtacgaatgtgtcttgtcctttcgcgcgataatgctcacgctgcacgcctttgatactgcttccaggtataatcggccattctgttactttttctcgttgaataggcatatcaatcacgccaattccttcacccgctccaatatggaggggggataaacaatgtatccaaaaccaacggcttgcttccatcatctcactcctcttattcattcggtttccatgttccccaaagtgctaacccgcagccatcttcacgatcaaacgcttctttgcgccggttacgatcggatactgattgaagccacattttttcggccagttctgctggatctccttcttctactgtaaagaagtaaacgctacccgcagggactaagcggcggattgctttttcacgccctttgtctttatttgctaagctccatccagagataggctgccaatgtggaacagatgcccaaaccaatttcagtcgtacatttgtatcaaatagtggttttgacatgagctgttcatccagccagccgggctgccatcctttactgaaataagcaggtgtcgccaatatcatgcgaacatacggcttgttcttgagcgattctttaatcatatctggacatgtccaatcttgttggtatacatgtggccggtcttctatatgagccagccgcctttcaccacctatcgggtgaagacttgagaacggctttaatgcttctgactcttcagtagataactctattcccgcctccagtttaaagtcatctgggaatacgagtgattctgttgaaaatagatgctgatcttttgcctttttactgccagtttccacctcaatttgtgtccgttcctgacgctgtaaggctggaataaatgccggtggtgtttcctttttgaaagaatgattttccttctgcatgtgttggtattcagtcaaggcttccttcacatgactctcatccactgcgtctgtcagccagttcaccatccactttagtgatacaaaagcaggcggcgatttcatttttttacgagcaccagctccaattggtggccataatgcctcactaaaacggcctgtttttcctgtaccaaaaaagccctgtccttccgacatcattgactttggtctcacttgatacatgccatactcatcatcaaataactcaaggtcatgaggcattggcacatataaatgatcatgccagcgatataaaggacctcgcacaagagattttgaataataagaaagtggcgtcgtgtgttttattgattgtcgtttcttcgctagagctgtacgaagtgttcctgcgaccacacttggcggaacatcgtttaatgaacgcgcccttatacccggtacactttgaaatgggcgtgcatcacgaataagcagcggatcaagcggttgaatgtgaaaccatctttcaggcatgtccacttacctcctctagttgaagagcaatgatcatacattcagcgattgtatgtaattcttctaatgtattcttcttcggtatatacttcgcaatcaattgatcgatccactctttcgtttcttgctctgtttttgcttccgttttctttttgaatgcaagacgtcttatctctagtggaatgagttcatctaaaattgctggctgttttttaaatgaagactgttcgtatgtttgatacaactctcgtaagccatatgcaaagccagatgtgaaataagactgctttaaccacgtcgtcatctcttggatagacgctactggatcgagttgaaatgagactgagatattcattgcgtctcctccgccacgtttttggaaatgaatcgctaatgaatttcgctcttgttttgcatattgttcagcctgacgtgccatgctccttacttcttcgagaggctcaagcatatgaacgatggcgatgccaattgaaatcgaaggaggtgtctcactatgttgatgagcattcatcgttgaaacaaattcactttgtaatctcccagctgcttctaagcatttgtgaaccggtacataagccatgacatcatctccaccaccataaatcaatgtaccttcacattcggaaataattccacttgcctttgaagcaaaagttgagagcgttttagaaaatgcaatatgactttctacatgttgtatatttcgcagttggctgcccattttatctccatccgccatgagaaaggcatagtaaggtgaaggtgctggtggtttgaccggccggccatgatgcttgctgtattcacctttgaaatatttttcgagcagctgtgtgatatcatttttcgcttctgttcgtgtggtcccgacaagtccacgttgttcaagataatcttctattcttctttcataaaaaagcgatgcctcactcaaatcaagaggagctactgttagattcatattcttaagatatgtttctacatctttcacatattgtgtggcagctttcttctgttcattttgtttcaacatgttttgatagggagcaaacgctttatcgcagactgatggaaaggtcatactcgggtgcttatgtatagataatcgtttgatcactgaaatcgcatctaatgattcatgttcaccaattccccatttagcaagttgcgccacttgctgtggtgttttttgcttttggaaaactgattcccggccaccatcaagtgatgattttggttcaccgaataacgcccctggctcattttgtttaaaatctcttaaagtcttccttgcagccattaaaccttcgacttcttgaagagccatatgatatggacttgcggacgcatttgccgcttcctcttgagtttgcatctcagtccacacagcataaaattctattaaatcatctacttgtcgattccatgtgcctatttgaatataaggatcaactatttctctaacaaagtctgcgtattccttccatttgtcatagattgcttttttcacttgtcttgcaatggaggaaggctgttcgtgtgaaattcctcccaatattttgtttggtgcgttgtttgtttttgcagaggattcgttgaacacagggaaaataagcgttccacccagttcttgaaatttcttcgcacctgctttacttaattcagatagaagaaaagagccaaaccataaatcacgcgtccgccttgcttgcgcaataaattcttgaacaggccctatcgaaaatagcattaatgtttgtttttgtaattcttctgacaaaatgtttgcacctccttgctatgtaaaaaagcttgaatcgccgatgagtgcgtacggccactctcgtcttgtaatgggttgtttgagtaggtggctgttgggtagatactttgttcatctgtcacatcgggcaaaggctttctgtcccctaaaagcgataaagcttcgatctttggttgctgcaacaccatcaccatgcccactgattccttttgattaatagctaacggttttaagatgagtggtgaagccaaacgatcctttcctttaggtaggagcgttgtaggatttgggtctttccccttatctttaggagcaaatcgaaactgaataggcaaaccaaattgagctctaggaaatgcttgatattcaaatggtttctcttttggatatggggtttcatgacctgatttagccttacctgttaacagacgaatagtatctgcttccggccaacaacttctccccatttttttattcgggtttgatcttcttcgaaatgtttcatatgtctgaatgacggatcgccagcttgagataattgatgatggaaatgcctgtactttgaattcacgactaagcgtcggccattctcgacttgatgctggcaattggatgtcatattctaaaagtttttgctcaaaccatttttccaattggctttttgtcctcttgttgtatggtgaaaattgcttgcaatataaactgccacacccacgtctcgttcttgacccaagtccaccgaagttgatccaagcccataatgctgcttcaacttcttttttgattaactcaaattgggttgtttttttagataaccggatatttaaagaaaattgcgccttcatgaggtatggtgtttgatctttcatatttgaaagaacataccgtggaaaaggatgatttttcttatttaaaaatgattttgaatttcttttcaattcgtctttctcataatgcgttaccacttgaatttgactcgcttgttctgtatgaccaaatatctctgcttctcttttagataattcattcgcatttttgcaggcagctcctcgagttgcacgccaccagaaacgaagatgtccacgaattgcactttctcgaatcggtctgtcttgatcaattgagtttgattggggccctcccccaaacattggcgtaaccaaatgaatagtaagcggctctttaaaaagtctttggtcttcatggattttcgtatcaatcgcatgtttcacatcatgccaattggttttgggttttctagattcccttgtcatgtcgctctcctttcttcactttgttatctgtttctgaaacagcttggcatatgcatagtgagggaaaaacatgggattgttaatgagcatcagcaattgatttaattggaagttcagcgttaacagatcgtatccatcaatacgtaaatcgctgagtttgttttcatctaaaaatttttcttcttcctgatatcgtttttcttgtttgaaacaatttaattcgtttgaccaccatcttagatgttcatgttcattaggtactttcaattgaaattcattgctttttttcatgagcatgaaatcaaaggacgccgctaatttagctgctttacttgaaattgtttggtctccttctcttttaaagttacttgctaaaatgagcaaaggacgcgtcctcttttgtgtgttactttcacttgtaaagtaacctgtagccattctagcaattcctgttgtttttggtgttaactgttttattttttcagaccattcttctaaacctttttctttcaaattagagcttttacattcaatagcaaccgcaaccgcctcaatcggtataaacttcaacgaattgtgttggaacacatacggcgtatactgctcatcaaatacggcaatatcgacttcgttagaatgatttccatctgagtcaataatgatgacaccttgtgctattgaatattttttaggaatgattttccgaaaaaactccatccacatcacttctctagaatcccctgtcagccctccatggttagaagcaaagtccacttcttctgatatcatgctgtttaatctttgataattctctaagatcagctgctccactttaccggttcgctccgtttcacccaaaccaattcctccttcatcattcattacgaatggataaaatttgaatctaaatgactacttttcatttcgacttattttgagatttttttaggtttatttaggaaaaagaagaaaaaaaacatgactgcaatgagtcatgtttttactatacatatgaacagtctattttgatggcttttgtatctgaaagagggtgttgtaagaagatgatctctgagaatgtcatacccgtttaagacacaatcatttaaaatcacgcactcgtgtagagtgcgaactgtaaccgaattgtcacgagaaataggaaatcacttatttcaatcaacgcctcatgtagagtgcgacgtatgaatatcgactttggaaacagcatgtacatatttcaatccacgcactcatgtagagtgcgacattttcaagctcgaacagaaaacatcatttcttatttcaatccacgcactcatgtagagtgcgactgcgatttccaccctaattataacattttttagggaatcatagtcaaaaccctcaattttctatatagaattttgttttcacctctaaataatatacattttttctcgtttttgtcgaataaaaaggtgcgaatgcaccagggattttatgttcacctcacattcgcaccgaatctttcttaatcctatttaaataaaaactattgctcttgaaaacatacttatttcactgtttcatcaacaggtttgaattcatttaaaaacatgtctactgagccagagtcatgtttttcacccctaaatcaagctcaactgtcaatatttctttcaagctacctaatccatacactcatgtaaagtgcgacacatagaagcacctgagcatggtcacacaatcattatttaaattcacgcactcatatagagtgcgacggaacaaaggcgacgagtgaccgccgacgttcgggatttcaatccacgcactcatgtagagtgcgacgggctcaaactgtcaccggctttgctgcaggtcaatttcaatccacgcactcatattgagtgcgactgcgatttctgccctaattataacattttttagggaatgatggccaaaacccttaattttctatatgtaattttgttttcacctctaaataatatacattttttctctttttgtcgaatgcaaagggtgcgaatgtcccggggattttatgttcacctcacattcgcaccgaatttttcttaatcctatttaattaaatactattgatctaaagatacttattcattatttcatcaacaggtctgaattcgtttaaagaaacatgactactgagccagagtcatgtttttcacccctaaatcaagcacaattgtcaatatatttttcaagccacctaatgacgagaatttcagtcctcacactcatgtagagtgcgacgacatcgtttatcatctgaaacgtcttgcacgccgatttcaatccacgcactcatattgagtgcgacacattggttgagtacataattaaaaaattacaaatatttcaatccacacactcatgtagagtgcgacgctgtggcgccttattacacaccagtaaaaaaagaatttcaatccacgcaatcatgtagagtgcgactgcgatttctgccctaattataacattttttagggaatgatagccaaaaccctcaatttctatatggaattttgttttcacctctaaataatatacattttttctcatttttgtcgaataaaaaggtgcgaatgcctcaggaattttatgttcacctcacattcgcaccgaatctctcttaatcctatttaattaaaaactattactgatgataatcatacttatttcgctgcttcatcaacatctttgaattcattaataaaatggctgagacagagttatgtttttcacacctatttcaagcgcaatgtcaataaatctttcaagctacctactgacaagaattttattcctcacattcatatagagtgcgacaaatataagacctgtaattaatacggctactgtatttcaatccacacactcatgtagagtgcgacgcgtctttctttccttctggtgcatcctcagcgttatttcaatccacgcactcatatagagtgcgacgaggatacgcctatgcaggatcgggcaatattatatttcaatccacgtactcatatagagtgcgaccttttagaaagtggattatgagtggagctaagttatttcaatccacgcactcatatagagtgcgaccttttagaaagtggattatgagtggagctaagttatttcaatccacgcactcatgtagagtgcgactgtaagggacgggaggagaaaaacttgaataaaatttcaatccacgcactcatgtagagtgcgacatatttacaagctgcaggagaaactatttgtaaaatttcaatccacgcactcatgtagagtgcgaccgtctttcccttatcaatggcgtatctggatacgatttcaatccacgcactcatgtagagtgcgactgcgatttctgccctaattgtaacattttttaggaaatgataggcaaaatccacaactttcaataaagaattttgttttcccctttataaaataaacattttttctcaattttgtcgaataaaaaggtgcgaatgtccctgggattttatgttcacctcatattcgcaccatcagttcctcttacaacttcgtcatatattccacaataaactcccaaaagccaggtccctcctgataaatcagcctgtctactttttcgatgagtttgatatagagttcttgttcgaggtcttctctttcttgatatgccgtgttttgtagtttctttttgatcatgggtgtgaaggtttcaatgagttcttccatttctccattggtcattttttcttcgttcacggacatctccccctgtttcttcttttagtttgttgagcgcttttttgtggatgtttgagatgttttgtcttgattcacccagccgatcggctatttctttcattgtttgaccttcaacataaatatgggttaaaaccattttttgtttgtctgtgagctgctggtaggccttgtacaatgtttggtcttgcaggtgctcccccaggtcttgctggttgaagagcacagcttcatacgtatctgtttgaacagggtctttcacttcttgatgatcaggatggtcgagtatgagcggaaaacgctgctgcttttttttgactcgtttgtcaaagtcgactgaaaagatgcggatcattgtggagatatacttgatgatgcggattttttgataaaactgcttgaactcggaatctagttttttcgcattttcttcgtttggctcttccatgacttgcttaagcagctgctggtttttagggttacttaaaaattgctgaatgagcgggtgatcaacgatttcattccattttgctttcaataacagccgataatccatgtgcatcctcccctttgttctctctacttgcattaagtggacaaaagttaaaaaaagtaaactttgtaaaacgggtctaatggttcattttctccccctttgatttcctatttcttctttcataccacttataaagatgacgagcatccgctgggaggtgagacaaatggagacctttttttcggaggaatggctgaagcagctcggtcaggctggctttcctgccattttgacggtttatttgctgacacgttttgaacgaaagtttgatgaattaagcaagctcatccaacgattggtcgctgttcaaaaaaatgatgaatcagattgacatcttcttgattcgtttcaccttatgaaaacgagggcgaaatgaaaggccttttgtcacctcacacaatacgatgttgaaaggggattttatcatgagtgaaaagcaaaatggtgtaccacagccgattcgaggagaaaaaggagcaacggtcaaaattccacgtaatctcgagcgagacagacaaaacccagatatgctcacgccaccagaaaccgatcatggaacggttcccaacatgaaatattctttttctgatacgcacaaccgtttagaaaaaggcggttacgcaagagaagtcacggtacgtgaactaccaatctctaaaagtcttgcctctgtgaacatgcggctaaagcctggtgcgattcgcgagctgcactggcataaggaagcggaatgggcgtacatgatttatggggaagcccgaattacatcggttgatgcagaggggcgcaattttacagaggatgtgacagagggtgatttatggtacttcccttctggcttgccgcactctattcaagcacttgaaccgggagcggaattcttgcttgtgtttgatgatgggtctttctctgaaaatagtacgttccaagtgactgattggcttgtccatacaccagaggaagttgtgctccaaaactttggaatgacaaaggagcaatttaacaagctgccagagaaagagaagtatattttccaaacaggaattcctggttcccttgagtgtgacaaggtgaaaacagagcaaggagaagtcccgaattcctttaaatatgagctgttaaagcaagagccgattacgtcaagcggcgggcaagtgtggattgcggattctaccaacttcaaagcgtctaaaacgattgcctctgctcttgtgaaagtcgatccaggcgccattcgtgagctgcactggcatccaaatacggatgaatggcaatatttcatttctggaaaggcacgaatgacggtatttgcttctgatggacatgcgagaaccttcaactatcaggcgggagacgttggctatgtgccatttgcgatggggcattatgtagaaaatacaggtgacgaaccgctttatttcttagaaatcttcaagagcgaccattatgcagatatctcactgaatcagtggcttgcggtcacaccgaaacagcttgttttggatcatttagatcaaggcgaagaattcttgaaattgcttgatactgaaaaacatcctgttatcgctgcacctaaaaaagaggattaattccaaccttcctgcaaaaaggctgtcctttttgcaggtatcttcatgtaaaggagtgttgtttacccatgcaacaatctgttcacgctttatggcaagggctgaaatggctcatggcgctatcagctgtctgttacatatttttgttgttttgtgtgctgttctttcatttgacgggtgctttttatcattcgattttatcgctgcttctgtttatgggcatctatgttgtacttgggatctcttttgaacatctggaacacgtgctcatgcggtttgttcgtaagtgtcggtccaaaaaacgatccatcgttttctatgccgttttatttcaccttttgtttatttggggtgctgtctacttatcagatgaattggttgacggcattttgctgactacttctgaagaaattctctttgcgctaagtctttggttatttcattttttgtttgattatgcgacgttttcgtttgataaggaagcttcgtgaggcgctatcgtctttttgtggagagcgcttgtttgacctgctccatatgatgaagatcatgtttaatcaaaccttgaaaataacttgataacgtcagctcggtttgaccgatcagaaagggtgtagtccagcgagatgcttcgattttcttcatttcttgaagcaattctgttctaacagcaataaatcgcccgatcgtctcgcttctctcttcctttcttgctctttcggctgactgctgattcatttcatgcacatcaggtgcctgaggtaacgctttattgttccaaaattcctttaggcgatcgtgtaaaataaattcatcccatggaacgaaatgtgcgatgatctcagcaatgctccactttccatcagcgatggcgctatgccattcttcttctgttacttccgttagtgactgtacccattcaagggtgtgtccatagtgttttatcacggtatctttgttcatgttttgttatccccttcatgtttttaaaagaagttgatcagaaattggatagtttcattcttgctaaatcatttataacatattatcatatactttaattaccaaatgaaaagggggaattgtgatacgctgtcctatataaaagagcttatttttttataccaaaataaaccgaccggtctgtttataaaagaggaggggaaataatgaaatctcaaaatgtgatcattatcggcagtggtgtagcaggattggctactgctttatttttaaaaaaggctggaatggaaagtacgatttatgaaagcaggtcagatgaagaattagaaacaggagcaggttttttactctctccgaatggggtaaagattttggatggaatcgggtgtaaaaatgaagtgatagcaaatgcaacagtgataaagaagatccagcaaataaacagtgaaaatgaagtagaagcgatctttcacaattatagtgaaaaatattatgatgctcctttactgaacgtcatgagagaccaaatcatcaaatcacttttaaaagaagttcaccgtcaaggaatagaagtgaaatacaacaaaaagttaacctcaatcaaacagcagcctcattccgttcaggttctttttgaagatgaaactgagataacaggtgatattgtaataggagcagatggaactttttctaaaacaagagaggctattgcgtttaatgctaaattagactatagcggtttttggggactgcaaggagtatcgtttgtgaaggattttgtattggatgaggcaacaagttatttttacaatgacggaaactttcaattcatttttggaaaagcgcatccaacaaataaaatgaatattttgtggcaagctttctctcagtgtcctgagaagttacctacaaaacattttgagaaagccaataaagaaaccatccgacagttattatataaacaaatggaacattggaacattcctaaacacctttctgacatcatcgatcatacaaacatgttctttccaagaagtatctatgaaataaaggattttcctgtgtggtcaaaaggacgtgttgttcttgtaggtgatgcggtacatacggcgaacccttttgttggtcaaggagcatcgtatagtctagaagatgccatgctcatagcaaagatgctaagggatcatgattatcgagatgcgttctattattatgaaaaggatcgaagaaagaggacagaagaattgaatgcgctatttcagcacatgagtattcaaaacgatattgataaaaaaatgaacgaatacacgattgaatgggatgaagaaacttacgtatgagatgaaagataaaaaaacaccacttatgctgaaaagtggtgtttcttgtgttttctccgtgaatagaggatcgcaccgatcaaactgatcaatgaaatcaatgcgagaattctgatataaggcggatagtaggttagcacgatctcgtttttgcctttttctattggaaaaccgataaacgcataattggcttgttcaatatcggtttgatggccgttcaccgtgagctcccatcctttttcatatggaacaggcagaatcatataatcatcgccgcgcttgttctcataagaaatcgtaaagcggttatttttaagtttcacctgctggctgccatcatcctgtttttctttttcatatgcccgcgcaagggtgcgataaggctcatgatacagctttaattgactcagctcatacgtcccttttggaactcgtatagaaaggattttttccgcagggactcgaatcgtcacgtcattaactcctgttttgtagatagacgtattgcttttgcgtgatgtgacgtagtcatccacagataactgaaacccttcgttacggtcggtccgcttcacataaaagctcacatacacatccccggcacgagcgatgtcatctggcagtgtgatattcataccgcccatatccccgtatacatcaagcacgccatgttcgtatacagcttgttctgtatgaatactcgtatctttgattcgatctgctgcgcgctcgatttcagcgttaccttttttgtctaaaatcacgccttgcagcatcgcatgctctttatcaagtgctgaggcatcctttaaggattgttctgaataaacggtgctcgttgttcttgcaaatggcagtgaccgagtattttcatatacctcataatgttcacttttcaagattggcttaaaataagctggtggtgagtaaggcatcatgctgtttctcatataatactttccgtaggtcaggctgtataaattcgccctgtcccccattgttgcataacggctgacactttcccttcccatatcgatttgcaggtcattccagtagaaattgagcaaatgctgattcaatatacttgaatacacactcatgccttggaagccttcaaataatggggtattgtttcgcacgccattcatccaatcaatccgggcgagcggatcctttgagcggctttgaatttgctgaatgagcttcatttgttcatgtccagcatatacctcactattcagatacgtatctgatacgctcttaatattgcttctttcagataagtatccctgctgatacacgcctgctgtcagtaagctgatggcaataagcacagctgaaaagagacgaaggtgctgacgtttttccgcatgcatccataggaagaacaagctgatcacaagcagtcctatacctgtaaacacaacgacatccatgtttccctttgctcgttctgaaaggacgacagcgagaaggaacacgatccaagcgcctaagaccgcacgctttttccacttccactcgatttgtgagaaatgcttgatcgtgatggcaacgaccgctccaactgtaaaggccagaatgtattcaaatctgtactgcggtgcagaaaaaccattaaacacgctcgccatctttggactgtagtgaaaaacaatgagcagcatactgatggatgtaaacatgaaaaaccacctgttccggtaaagcggaacgaggaacatacaaatgagaaaaatcacaggtaataaatacaccctgctcgtaaacagcagatgatcatgcagctcgaaccaaggaatggtctgttcatacggcggtcttatattgttaagaaagccataaacagacgggataaaaaaggcggcactgatcccaaaagataacagcgtagagatcgcaagtgtccaaaatactttccacccgtgctcctcacttcgcagcttgatcatatatctgaagacaagatagatcgctaaaaagataaagtgaatataagcaaagtaaaagttgttgatcagcatcagactgcaactcgcaaaaaaccaagcgggcttacccgttttgaatatccgctcaaccccaagcacaagcagcggaagccacatcatgctgtcggtgaaaaattcccaaaacgtttgatgccggaaatatacaatagataatccatagattgcggcacctgtcagtgcacccaatctattttgaaccattgaaagaagcacacggtaagcgatgaaaagaataagcgtcagcttgatcacgctcagccaaatgacggcatttgcccaaaaatggatgtctgttgactgtatgagatggagcgcattcatcagccagacgacagcgactgtcaccataaagaccgtcgacgttgtgaaataataccctaattgcgtgtatgtaccgccgcctagaccgaattgataggaataaaagaaattccctttgacgtattcgtcgtaaagcagctttttaaatgggagcatttgcgaaatgccatccccatctcctgtcatgtaccggccttgcgtatattcatataagaaaaaggagtggcctaataatgcgagaatgaggcacattccaatgattatccatctacgtttcatcatctaaatcctttccacaaaagatccattgttctttgaaacaaaacaacccagcaagcgattcgtgcttgccggttatttgactccacgttatttaaataactgcgttaacactcggtcttgttccttagagcttgtctcttgctgcatgacatttgattcttggatcaaataatgcggcctctttttcgtttcataataaatgcggccaatatattcaccaatcacacctagactcaaaagctggacacctccgaggaaaagcacagccgatattaaagtgaaataaccaggtactatcacgcccgttttgacgatttgaataaaggtggccacgatgtaaatcaaagagaggaataagatcagtatgccagtataaaaacaaatacgcagcgggcggttgttaaaggaaataacgccatctatgccatagttaaacaacttctttaatgaccattttgtatcaccatgctgtctttctacattttcataatagatgaccttttcttcaaacccaatccagcaaaaaagccctttagaaaaacgatttccttctttcagctgaagcaatgcatcgattgcttggcgcgaaattaagcggaaatctccgacgccatcacgcaagtccacttcgactaccttgttcatcactttatagtacatggatgataagtaagagcgaagcttgctgtctcctttacggttccgtttggcaatgacttgatggtagccttcttcatatcctctgacgaagtcctgaatcaaatacgttgggtgctgcaggtcggcgtccatgatgatcgcagctactccattcgcatattcaagtcctgccagaatagcggcttccttcccaaagttacgtgagaaggaaatgtatttgacctttgcacttttgcgagagagttctctcatatattgaagtgtattgtctttgcttccatcattcacaaaaatgatttcaaagtcataatgaaaatcgcgaaactcttcctcgagtgcctcaaagattcgtctgatgttttcaccttcattgtaagaaggaattataacagagagcaattctcgttccatatcgcaccttctcttcacttttttcacatagtctgatatgttcattattccttttttatcaggaaacgaaacccttttttattatccataaattacatgtttctttaatcgttccattatatcaaagttttatttccattgattttcagcaagatgaatttaatgtaattttaagtttaaccattgtaaaaagcctgtaatttcgatcacagactgggtattgtatcataaaattgtttactcatttatatattttcctatttattgaaaaagatgaggggcacttcttttaatgaagcagccctttattctgctcttgtagatgctcgtttgccttcgattgtttattttggaataaatgcagctgcgcaccgtagctctcaatccactcttggacaatccgttcagttgtttcctgtcctttatacttgtggccagcctttgcataggtcgtttcaaaatcactccaaagcagctctacccatgtacgtgcttcgtcatatgtcagcatattgtttttttccatcagttgttctgttaatcgctcaaagtattgttccatgtcggttcctccttcatctagcagaaagtgcctttttaaaaaaaactcttttttcatatactacccttacgtcttcaaaagacgcaaatgatttgtattgtttggagggaatcgaaatgcgtaataaagcaaaaggctttccaaatcaagtgaatcacaaatttgaaggcgagccaggcgccacagatgcttatgcgtctaaaaggccgaatggtgagacgaatacacgtccacaggaacgaatgagggcatcagggaaacgctaatttttccaaagggagtgcttgagatatgagttcaaatgggaaatcgtatatggaagactttgttcaattaaggacaaccgcttaccctcaaccatgggcgaatgcaaagcattctgcctctcaggtcaacggagaaacgcagcaaacgcagcacgacatcgtacttcagaacaacgtccgtaaacaacgttcgaagtaaagaaaaggactgatctctcggatcagtcctttttcgtaagcattgaaattggcagtgcatcttctttatttggggctgatactctgtatccccacgcaaatacaccatttaaatattccacgtaaaactcttcatctgtatctttgatttgataagtcgttttcgtttgaatcaaggctggatctactaagtaggctttggccatatcgattttccgttctaagacggcatattcattcacaatgccaagctgctcagcctttcgtgctttttcagaaagagaggctatctcctgctttaattcgtattccgtcatctcactataacgtttgtccatctgtcattcccctttgtctaaaacgtgatcaattgtgtcgagatcaaagccttttctgaataaaaattgcttcaccttcatcttcttttcaaatgacccgtcgtatcctaccttgcgttttgccttctccatcatataaaggagcgcttcttcttccttttcctcttcttgtccatcataggcttcttgaagggctttatcaatgatctcaaacgaaaatccttttcgctgcagctgcagcttgatgcgctgctcgatctcttttgcggaacgatttttttcttttctcacaagcttctgaacctgcttcacagcttcctccagctgtaagtcatcaggatattgcgatagtgcttgttcaatgttgtcatcatctatccctttgagctttagctcttttttcaggacggacggccctttgctgttcgttttacggtgggtgctgacataggcttccgcaaattcaagatcatttacatacttgtaatgctttaatttgtgtataatttcactaatggcaggtgccgggatttcttttttcgtcaagtaatctgtgacttctttcaccgatctcattcggtaggataaataatcgacggcctgctgaaatccttttttcacagcatcaccgaattgaatgtcgatgatatcggcttcgtccagctcttttccctttttcaaatcgtgctggacgagcacatctagatccacgctaaacgcgtacttttcatcaagaaagatgtttacccgctctgtattgtttttctgagcggagatttttgtaatatagggcatcctgtgatcactccttttttcaaacagtcaggatgtttcttctgattcaaattcgtgaaagatataggtatgtatatgagaggagagatgtcaattgaatatcgccatcaccggaggaaccggttttatcggccagcacgtcacgaaagtgctcgctgctgaaggacatcatctatatattttaacaagaaatccaaaggaatccgaacaaaatcatttatactatgtgcagtggctgacagaaggtgctgcgcctgagcatgaattgcctgcgattgatgtctggattaaccttgctggaaaatccattttcacccgctggacagacaaggcaaaagaaggcatcctctctagccgtattcaatccacacaagaagtaaggcgcattatagaagcgcaggaatcgaaaccatctgtgctcattcaagcaagtgctgtcggaatttatggcacgtctcaaacaggagattttacagaggaatcacctcctgcggatactgatttcttaagtcatacatccaagcgttgggaagctgaggggcaaaagattgaagcactcggcattcgtaccgtctacacacgcttcggcgtcgtgttaggagaaaaaggtaccttgccactgatgacactgccatataaactatttgccggcggaacgattggctctggctcgcaatgggtttcatgggttcatgttgaagatgtagcacatctcattgcttatgccatacacaatgacgacatctcaggtccactcaatgtcacatcaccgaatcctgttcaaatgaaacagcttggacaaacgatagcgtctgcccttcaccgccctcactggctgaaggtcccatcctttgtcattcgaacggcacttggcgaaatgtcattacttgttttagaaggtcagcgtgcgctgccgaagaaggcattgctttcttcttatgactttttgcatcctgaattaaaagaagcgattttgcattcaaaggaataatttttgtcaaaaacacccatcctattagaaatgagatgagggggcgattttgatgaagaaaaaagaacaccagccaacttcaaagctgaagaaaacccaggaagtcctgtatcagcaggaattcaaaaaagcggaaagagcagcagaaaaaagaaacaaataagatggatattccactccaacaagcacataactaaagtgatcttgtaaaggagggaaaggctttgaaaaaagaccaacaccaaaaagccaatcacgagcttgcagcacaagagtcggatggcgaatatgttgaattttccaaagaacttgcagatccgaatgacgtaaaagcaatggcacgtatgaaagcagccgaccagcgcgccaaaaaacaataagtaaaaagcagaccctttagcggtctgcttttcttttatttgatttcagtaagaagacttgatgctttctgacgtgatttttcctcaggcacctcttctggataaccaatatgaaggatggcagcaaaccgctcgttttcctttagacccatgtcctgttgaaagcctttgtcgtataagatgcggccgctcttccagaccataccgattccttgatcccaagcaagcagctggaagttttgaatgagtgcgctcacagcggcaaaatcatcatttctcactactgggttttcgtcttcctttaacactacaagtaaaagggctggaacttttgaaaagtaatctctatattgattgatcttttcttcctttgcatctggattgttgcgtttgaagaacgcaacgaagcgatcaacaaatgtcgctttcgcttcctccgtcactgcatatagaaagcgccatggctccgtaattttatgattcggtgcatagaccgcatcctctaataacggctgaagctgctcaatggtcacaggcgtttctttgaacttccgaatggatcgtctatatctcacagcgtctcgtaccgttaacgcttctgtttgttgtttgatttctggcatatgtgtcatcctttcaatcaatcttaattgaaattgattctcattcacattataaacatcatttcgagcagttgcaaatgatgtttcccctcccgtctgctaaaaagttgtttgagtttttcaagtaatgttacaatcatattacgttttaaacaaattttgagaaaaaagccaagatgatgaaatgatttcaggtattcccattttgtctgattcggttcttttgtcaaaaggctttcaacccatgattggaagggaggcttctggatggaatgaaaatcaatatcgggcaaatcattaagctctaccggtataaacaaaatatgacccaatctgaattggcagaaggaatttgttctgtctctcatttaagtaaaatcgaaaatggctcaaaagaggccaatcaagatacgatcaatttactgcttgaacgactcggcatcagtcaagaaacgctgtcacaaaaggcgcgtcacctgctgtcactcttggatgagtttcaaatgaatatgtatttctatgcactcgatcaagcggaacaaaatgcagaaatgatcattcagcacgaggaacagttcttttcgctagatttaggcattcagtatcatttgtccttatttcaattttatttattatcggacaagcagccgcttgccttaaaaacacaccgcgtactgaaaaagtttgaaaaaacctttattgaaacggaaaaagaaatatttgaatatctagatggcattcatctcattaaaaatggtcagcttgaagaaggcataaagaaactggagagctgcttttcttatgcgtctgttgaacaaagtgacctgtattatcactatgcaaaagcacttggaaacatgggacatcttggtgatgcgcttgaagcaacccatcaagcgatggatttatatagacaaaagaacaatttcaaacggatcattcactgcacactcattcatggcgtgatctcactggaactaaaagcctttcaaacagcgaagaaatatttaaaagaagtgattttgcacacatccctttatcctgatgcctatattaaaatgaccgcatatttttattatggggtacttttaaaacgggagggtgatttctcttcagctgtgccttatttactagattcactcaattactttaatcaagaacagatagaagaccgttactgtgaaactctgtatgaaatcgcgacattatatgctgaatacgaccgcaaaaaggcacttccctacatacatgagctgttaaaacagcctcgtattcagccaaactgtttatatatgatcaaaatctataaattgatgattgaggaaaaccctcttgatttgaaaacctatttgatcgaagcagcccttccttactttaaacataatgagctgcacagtgagtacttgtttgctcttagaaccttgctttcctatgcgtcttctgagcttgacgaacgtacctatatgtcctacacgaaaacgctgcttcatcatcttgcatcatatgtcccctattacaaaaaagcatgaccttctgccgatcgaaggtcatgcttttcctattcattaaatggtcttctgttgatctgtatcaggacgggtgacttgtttgactgaatgaacataccgttttctcgcaaagtaatcgtacgcatgctgcccaaagcctaaccaaatgctgagcacgatgaatgggatcgttccccataatgcagggatattgcaagcaattttcagcaatgtatagatccccgaatttttttggtttttggctaaggaaattgacacgatccgcttttctgccttttcttcacttattttgttcagtttgagcagctgcgagtgtcgaaaggattcaaaatgaatacggttcttccaatcgagagcttttaacaagtctatcgcttttgcacatgaaggactttgcccgtcataaaacacaagcagcctaagtgatttgatggaacgctgttctctttttttcgattcagcgagcttctttttttcttgatcgagataaatgatttttttcatagattgatcgccagcccttttccgtcatttgtttttttagttcgttcaaaggagattacaactagattactatagttgctgggcctcttgtattgggaaaaagcaaaccaacgtgcgttatatgagcctttagataagggcaaaattaaggttttcatggcacatatgaggtttttcaactaaaaatggttgggaaaatcgtgatgcgttgcggttttctgcggttttttgtagaattctgcggtttttctacatctttatgcggtgttttgtaggtgaaacgcaaaaacaagataaaaaaagactacttcccgttgcggcgaagtagtcttttggtttatattttttccaaaacttctactatttctttctcaatatctttccataagtaacgatctgtcgtatagtgatgtgcggcttctttcgcaaatacttgaaaagcttcctcaaaatcaggagcatccttgtctggttttttctcatcaacaaagcgctgtgcttctgttgagcgtggtccccattttcctacttcattcccgtcttgatcaatgatcacgataatcggaatcgatcttgcggttccgttcgttaaatactgatccatcaggtctagatgctcgtcccgaatgaaatagcgcgcttcaatgagtgcttcacttgcaatacgcatgaaaattggtacattgaccatcgcatctccgcaccaatccgctgtgatgacaagcgctctgagctttttcttttgcagcttttgaagcagctctttttctttttgatgaattgcgtactggttgtacaccgtgagtagattttctcggtttttctccatgttgtgtacatatgtacgttcagttaatccctttgcaaaccattcatttaatgtcatatttacatcccccttactcttcaactttaccacttttgctattcttttgtctaaaaaaaccttcacctagtgaaaggtaaaggtttttgatctatggacgccggctgcgatttgggtccatccctatcagcttggtgacaagcaccattgtgacaggtaaagatgtattctttttatacgctaaatattttccgcgccattcaggtttatatttctgtttaaacgatcgtaatccactgaagctgtacataaatctgacgttgttgaaaataacactcgccaaacgctccgtgagaaaggactgatgaaatgttcctacatttgataaaggcgccattcccatgttaaaggatttgtagcctttttctttcgcccattgaaaaaggtggataaacagcgcatccatcatcccgttcggtgcatcatgcatatgacgcataaggtcgatcgatatctccccttcttgatacatcggcattaatgacacaaaagaaatgatctccccatgttcatccttcagtatcgcaattggtgctttttgaagataatcttcttgaaaatagccgagcgaaaaccctttttcttttttctttccaagccagctatcagaaatctgttttaaggttgagatcagctcatctgaaaaaggaggttccagcatgtcaaacgtatagccttctcgttcaaacttattggccacagcccgtaaatttgattttttcttaccggagagagagaacgtttctaaatcgaccatggcttcttctccaagcttaaagaaatgaaagcctaagtcatggtagagcgccatcccttcccgttctacttgataaaaagcgacgcgatagcctgctttttctgtctgctgtaaaaactcttcaagcactagtggataggatgctttacgtccagaaggatctccgagcacaatgacgcagcggccaatgcgtccaaattgaagcatcgcctctccatcacttgagaaaaataattttttatcgcctaaaaagccaagatgactaagggcattgccgcccttttcttctaaaaatgtttttagtttttcctcatctgctttttctccaatcggaaatgctttcttattaaaaatcaatttactaatgaagaagaaaagcggtacaccgataagcgcaatcatgcttgtcatcgtgatgtgccgttcattatgcacgaggtaatccttactcaagaaatgcccgattttggtccaaataaagttaccgatgacattatagttaaacaggacgagtaaataaccagcggcagccgctacaaactgatacaacgaataaggagcctgctgcttcacaaattgatttcgaagagagaaaaagacagccatgatgactggcagtataaagataagacttaagttaaagccttttaacaaagtaaacacaaagccgcctgctagggcgatcatcgtcagcacgtatgatcttttcgttcgtttgtacacttcaatggacaaaaccatcaggataatgccgaacattaaagaaagaccattaaatcctgataacaaaaagcgtggaatgctcgtaattacacctaatcgatcgacaggaaggacaacagacgccataatgagcaagccgcttccaaaggttaaaattgataatgatccgtacagtaaacggattaataaagcacggtgcagcacaattaagacgttcgttgtttctacggctggtgccattctgggattgccttcaagacgtctaagcgtcgttcccgttaaatcataagcagctagacaaagcccaaggataaacgggaagatcgagtacacgaagcggtacaaaacgagcgccgtcagcaccatctctttatcaaacccaatgtactgcatactcaataaaaagatgaggtcaaacgaaccaaaaccgcccggaaccatactgattaaaccgccaattgacgcaatcgcaaatacgcctaatacaatccggacatcgacattcatccccatagagacgacagccatgtacatgacaagaccagctgcgagccattctaaaaacgatgcaccaatataagcgtaaatcggatgcttcagtccgctttcaccgctctcaattgagctttttcgtatggacgccataatgatgtaaataggcacaatacaagcaaagatgatcacaaaagcccacagccacggctcttggctgataatactttcaacaggaagcaccctcaccaagatcagatcgctgaaaatagataagcccaaaaggaccgaggaagtcaaaagggcaatgcctttgagcagttttttcgtatcggttatgtactccttatatagaagtgttctaagccctgctcctgatagaccgccgaacccaaggacactgttaaaggagttcgcaatccaagaaatgcgaatcgttttccagccgctgatgggcatattcaggctttttcgtaaaataaaatcatataaggacatcgataacactgcaaccagtccaagaaagacaagaataaacaagtccattcgattcaagctgtcaatgatataaaacgtttttttaatggaaaggccgctcagttccttcttggcgacaaaaattaagacaaggataatcacgatcggaaaaagcatttttaagatcgtcatacccgtttttttgttccacatgtttttcccaactttctaagttgcttcatttatttcgactgaacattattatacaacaaataccacttgattcatgcagtttaacattcaaaagcttgacgaacctttcaattagaagtaaaaatcagtaatatagagaaaagagccgcttaaaggaagtgaacaagcgtggaatacaatattcatgacaccacagtattaaaagaagagattctatctccagaggaaaaaaagacatgggtgctttatatgaaagtactcacagctgcaggtcttggagatgtgtcagaatggatgaagctcgatatgagtatgcctcaaatgaaggtactcatgctgctcaataaccatggctctctcaaggtatccgaaatcgctgaaaaaatgggcgcttctttgtccaatatgacaggtctgcttgatcggttagaacagtctcattttgttgaacgaaagcactctgagcgtgaccggagaatcattgtcgtcgaactaactgaggaagcgaaaaatattttcagaagcatttatcaaaaaggacacgaaaaaatcaaaaactccctgcaacggctcaatgacgaggaaaaagaaaaagtcaacgaagggctggctattttagaaaaagcactgcgtcctgaacgcggctaaacatgaaaaggaaaaaagacggtcacttgagatccgtcttttttagttcttcttctacttgtttatctgagagaatgaaggttttttgaagaacgactctgtcatcccataaaagataggctaaaccgatgatgagaaatagaatgctgatccacgtaccgccagggagcagctgttcaagttcctcaatcgttctttctgagcctaagctgttactatagcgtatctcaaaaagcacatatttcgctaaataaaacaatgccgccatacagataaacatggcgccgacaattcttctaccagacatgcgtttactcctttaattccactgatttcttttgattaattccgtgatatgagcaaggtgatgctttgagtgccagacgtacatacctgttgcatcatataaggataccgtttgttgatcggctgggtgataataggacgcagtgaagtcttcttctgacatccctcgaagtaatgtcacccacctgcgatgcagactgctgattaagggcagtgataggctgatgggcgctttgctgtctggaagctcggcgaatcccgcctgatcatatggacgtatgtgcggtgtttcttctgtgagcgcaagcttgaatcgtaagtatgcattcagatgactgtctgctacatgatgaataagttgacggacagtccatcctccaggccgataaggtgtatccagctgagcagctgtcaattgattggtgaccgtttcatattcttggggaatctcagccaactgatcaatccatgactctagctgttcctttgttttattttcaaccggttcatataagccaatcggatattgtaatgacgtcataccctctcccctttctcaaatccttctagtacaaatttaccaatcatctttccttgttcaagggtttgatgtgcctgcttcaagttagaagcattgatcggactgagaacctttgttaaggtatgcgttatttttccctgctcaaataactcacccgcctctgtcaaaagctcatgctgtttgatcatgtccgctgtttcatacatagggcgtgtgaacatgaattcccatacaaatgccgcacttttatttttgagtaattgaatgtctaggttgtgctgattctcgacaatggtacagatcgtgccttgcggttttatggcttctgccatgcctttgaaatgtccgtctgtatcatttaggcataaaatgaaatccacttcgcctatttctttttcctgaagctgcgcaagaagcggctcatgatgatcaatgatatgatcagcacctaatgacagacaccactctcttgtttcaggtctcgatgcagtggcgatcacagtggcatttgctaatttggctagttgtatggcaatagaacctactccgcctgcaccgccgatgatgagcagtgttgccccttctgcatttcgtttcatatgcatccggtcaaataacgcttcatatgccgtaatcgtcgtcagaggcatcgcggctgcttctgcaaaggatagattggcaggcctttttgccacaatccgttcatccacaagctgatactcactatttgagccttgacgcgtgatatctcccgcatagtatacgtgatcacctggctgaaataatgtacacgcttcgccgacttcaacaactgtaccgcttgcatcatagccaagaattttcagtttttcttccttctgatccttcggtgatctcactttcgtatcaactggattcactgacacagcctctatcttcaccagtatatccctacccgttgctttagactcttctacttcctgatccatcaagctttgctcatgctcgatcggtaagtactccaatagtccaacagctttcactcgcttgcactccctttctctatgcttcttttccacattttatcataattttctgatgtttatgggtaatcaaacgagtgaatgcacattaagaactcttcaaagcctttctctcccttgctatataagaagggcgtgccttttgcaatgaaggaacataggaaaaccagcttgtggatttaaagaatagctgaacgtaataaaactggatgtgctgaagggaaaagagcatgaatagaaaaatagctagtaaaagagttaggtgatcagctgctccatgtatccattccgtgataaagaaaacaacaaaaccgatcatgatcaactgttccagcctttgcatgagctgggtcaagacatgtcctcgtttcgatagatcaccagactggcgcttcctgatctttctcgatttataaaaccaaatggtacattctactaagttatgagtcataaaaagagcgatgagggcgatcaataaaggtgatggggtataaaggacttgtgcaacgaatggaaacactaaaaaataacatgcaatacatgcgtgtctcactgataagagaaatagttctttttctatgtatggtttcatctgtttcacctccatatgtactacgtctgctctgccataaagttccctctgcttatcaaaaaaggatgccaaaaaggcatccttcctgaatcatatttaaaatgcagcgcttagtacgacaggtccttgcggcagcttgttatccttttttggttcaagggtgactgccacggtatcccatgattcgcttgcttctttttcagataacgcataggtgacggttccttctcctttgttatctgttttaaaggcaccagctggtaccggctgatctcctttaatgagccacacttgataaacagcagatgaatcaagctgatcctttaatccgtctgcactcacaaccagctcttttttgccgttatgctcaatcactgaaaaagcacccgttgtttttggtgatgcggctgatgccagtgattttgtcgcaacaactctgacaggttcttccgcctgttcttttccattcaataagaaatacacgtttccagctgctgaaatgagaagcagtgcggcaacgagcggcaatagccactggtttcgtttcttttgaagtggtttcatctcgtttggttcacgtactgccttgaggtcttttctatggctattcttttcttcgactgtctcttcttcaaacacctgggataaaatacggtctttcatccctgccggaggtgtttggtcacctgctagaaatggaatgtcagacatgagcgatgtcaattcttcaagctcttctttgcaagctgagcagtgcttgagatgctcttcaaattgtgctttttcctctccttggatatgcccgttgaaataatcaatcacttgatgtttacactgagtcatgcctcttcctcctttcctccgcgagacagtctcgtccgtaagtgcttcaatgacaatcgaactcttcccttcaccgttccaatggggatgcctagcttttcagcaatgcttttttgtgtcattcctttaaaatagacatcttctatgatggtttgctgttcttttgacaatgtagatactgcttcacgtatgatttgtttttcctcgttccattcgacttcctttgatacatcttcttgatgatcggctaaatattcaatatgctcatcttctagtgccgtttcgttccggtgctttcttagaagatcaatggccgtgttgcgtgacatcatgaataaccacgatgagaatttccctttatccgtatggtattctcctatgccgcgccagagcttgataaagacttcttgaagcacttcctccgcaagttcacggcttccagtcattttataaataaacgaatataacacacgttcataacgatcatacagcacttcaagcgaaggcttgtgacgatcaaatttgatcttgtgatatagctcagaatctttcagtgtatccatggtcatctccttcctttttcatgagaaagagcatgctgcattcatcatgaaatccttcacgtattgcttatcactcgatttgctgaaataagcctactttgtactttactcttttttcaaggagaaaaaaagagcgccgaaaaaggaaatgtgctcctcatgagaatgtacttactgtacgaaaagcaaggccatttggatcacttatatctaaaaagtcaagaatccatgtgtttccattctctgttcagttgattttagcaaactctcatgtccctcacaatggaaatgaagtagaacgcattttttcaacatgtcataatagaaggtaacgaaatgaattggagtgtccttacatgatgttgacgatcgttctttttttattagcaggaatagcagaaattggcggcggctatcttgtgtggctttggctgcgtgaagcaaaacctatcagcttcgggatcgccggcagcctcatcctcgtcgcttatggggtcatccctaccttccagcagttcccaactttcggacgggtttatgcggcctatggcggtgtatttgtggttcttgctgtgttttggggctggtgggtcgatcgaaaaacgcctgatctctatgactggatgggtgctttgatctgtttagccggggtcagtgtgatgttatttgcgccccgcagttaattgtctcatgtctacaaaacaaaaagggctaaaataaggttattttagccctttgtcttcttttttagcgcaaaatttacattctaaattgtgtttcgtataaccggcggtacagaccgttcattttgagtaactcttcatgttttccttgctcttttacgccttcttttgtgagaacgataatgcggtcagcatgctgtattgtcgctaaacgatgcgcaataataaaggtcgttcgtccctgagccagctcttctagtgatgcttggataaaagactctgtctcggtatcaagcgaagaggtcgcctcatctaaaatgaaaatcggcggattttttaagaaaatacgtgctatggagatacgctgcttttgtccgccagataacatcatcccgcgctcaccaatgatcgtatcaagcccttttggcaaactattgactaaatccatcagctgagccttctctactgcctgccaaatttcctcttccgatgcatccagttttccgtataggatgttttcacgtatcgttccatgaaataaataaatctcttgctgcacgacaccaatttgagaacgcagcgatgcaagtgtcatctttctcgtttctatgccatcaattgtaatgctcccctcctgccattcataaaaacggggaatcagactgcaaagggtcgatttcccagcaccagatgggccgacaatggcaattttctctccttgtttgacctctagattgatgtcatgcagcacgggtttgtttgattcatattgaaaagaaacgtggtcaaaaatgatattcccttttaactgctggacttcgattgcatcctcatcatccttttcatctggtgtttgatcgatgagtgatgcgaatcgtttaaagccggctgcaccttttggatacatttcaatgactgcattaatttgttgaattggtcctaagaaaatacctgttaataggacgaatgaaacaaattcgccatacgtcatatttttttgcaatacaaaccatgcaccacacacgaggccaaataccgtgacgcttttaatgaggaaatgactcactgctgtatgaactgccatcatttgatacgttgtcagttttgtttttctaaactcctcgttatgctcgataaaacgatccatttcatgtgactcatttccgaatgctttcaccacacgaatgccgctaatattgttttccactcgtgaatggaattgtccaatgcttgaaaacatgttatcaaaagcagcagacatttttttcgtaaagtagacggataatccgatcaaaaatggaacgacaataaatgtaaggaccgcaagctgccagttaatcgatagcatgaggccaaacgcgcccgttaatgtcataatggcaataaataaatcctctgggccgtgatgtgccatctctccaatatccattaagtcattggtcatacgagaaacgagcttacctgttttcttttggtcaaagaagcggaaggacattctctgtacatgagagaatagctggttcctcatatcagtctcaatattgatgcccagcttatggccaaaataggtcacaacgtaatgcatggtggagctgataacgtataaaacaagcagcaaactgccccagaaccaaatggcttcccaattaccatttggcagtaaatcgtccatcactttactgatggctagtggaaaggatagttcgagtaaggccgccagtaccgcacaggaaaaatctaatataaatagtcccatatagggtttgtagtatgaaaaaaagcgtttaaacaattgacagacctcctactgatgagataaatctgtcaatatatcagcaaatttttcagcttgattcatgactgcaattggatcataaggccaaaagaattctgcatctagttgataggtttgctcttttttgacagcttttaaactcttccaaatggaattatttttatcaaatgtcccgccatttgattcatcaatgaatatataatctcctgcatatttcggaagggtttcataggagagtacttcgtagcctgttttactgtttaaaattatatcttcgacctgctttggtgggttcatttgcagttgttgatatagtgcctgtccacctcggtaaattccgttcccatacacatacacatcgtttttaaacgcgcccatgatggaaactgtgtcattctcttttaatgcagacttcactttttttcgagctgtttcgattcgttgatcaaaggaggcaagaaacgcctttccttccgcttctttgtttaacactttagccaaagtcttgatttcttcctgtgcatctttgaatgaattgtaagggtatacgagtgttggcgctatttttttatacacatcatagactttttcgtcctgtactgctgtgataatcagatcaggctttaagctaagtactttttcagctgaacgttcgtcactaatgtcctctattcctttgatcttgtccttcaagtgtacattctttaaatcttgtgttgttgcacctacagggtgaacatccaatgcaatggcactgcctaaatatccatctatgagaatgcgttttgggtttgccggaatgtcgatttttccttttacggtctcaatggttttcgtttgttcctttgtttctgccgttttggcttgttctttatgaccacaggctgacaatatcagcatgaggatgacagcacatatccaatatgtctttttcatatgagtattcctccttcattccctgatataaatgagaatagttatcaattactagtctcatgtattctaacaacctcatacgaaatggtctatggaggattctcgcaacttacatatggacaattgttggatcggctgcctgagttaattgggagacaaatcggttcattaaatgaatcacccgctccccctcatcaaatcgaaactcctctagctttagtggatagaaggttccgtttttcacagcagataattgacgaagaacatcgctttcctccagccgctgatccatttgttcataccacccatgttcaacacttacaataaaaaacatgtgatccgcctcgaattctcttagcctctctaaaggaatgactgtatgttgattagggagaagaacttcttctagaatcgtcttcggaggctttaagtcaagcgtttcataaaggtagaaggcgcctctagcatcataggaccacatatacactttgtcatgtcctctcatttcataaatcgccactgtctctccttttttcctaaaggaagatagatcatttcttgccttctgactcacatgtttgaagcgtttcacccaatcatctgcctctttctctcttcctaacaggcggcctgtagataagacttcttgtaccacatgaccaccgccatatggcaaaacaaggacaggggcaatccgctccaaccgcttgatcaactcaggcttcgaataaaaatagttaggaatgatgattaaatctagttgaagtgatttgaaaacgtcatcaggcgtgtgttcatctatgaccagcgcacctgccagctgatctttgagtatatctgaatgaagaaaggtttctttgtcaatgcagacagggcgaatgcctagcgcgaccaatgttccgacaaattgaaaagcagcaatccgctctggtcttcgattgtttcggaactgactaggggtccttcctgtcttccgcctgaagatcctgctgaaatataaactgtctgtatagcccacttgccgcgcaatcatttgaatttgatcatctgtttgcagaagacgtttttttgcttcatccattcgaatttgggcaatatagtccgtcacacttagtcccatactttgtttgaaaaaggtcgaaaaatagctctcatgaaaacccatcttatgggctaagtcttttctcgttagctttttttcataatgctgcgccatatattgcaaaatcatttcaatagaataatggaccttctcagtgtatggcttggattgacggtgaaagatgtgcatgatgtcctccagccccttcacctgttcttgggtgctttgactcgtcttcatttgtttgatgcaggaaaaaagcatggcagagcctttgaccatcgatccattatccgggagatcgtcataattcatcttatagaccaattcattttgcgcatcatttgccagggtaaattggttaaatgtgattgtgtgaattgacaccacctcgcttgataaagattggagcatgacgtttatacctgagcggatcaatatactgtcttttgcgtttagctgatattgtaatccttccatttcaattctcacagatccatcgcaagtcaagaacataggggaagatgtttgccaggagactgtttgtttgtcagaaagagatcgctctctactttctttcatgcgcagaatggtatgagtacgggttgtcattttctctttctccttccatataaaaaaagtgctaaaattttagcacttcaatggttgactggatgttcctgttcattaacgagcgccagccgtttgcaattctttgtttttctctttaaagcgttcgttatgagaagaaacatacgccactttttcggcttctggctcgatatacagctttgcgctattgagcgcattgactccgtcaacaaatgtcccagcaattaagcggaccttgcttttatgtgtacataaatcgcctaccgcatagacgcccggtaaattggtttccattttttcattgacctcgattagtccccattcaccttgcttgagtccccattctgatagcacgcttaaatcgcctttcataccgtggttgacgatgacagcgtctgtttctattcgttcgatttcacctgtctctaaatgttgaatagtgacagcatcaattttgtcaccttgaccatgaagttccgtcagttcatgcggggttaaaattcgtgtgcaagatgctttcatgttggcgacgtttttctcatgtccgccaaacatgtcacggcgatgcacgacggtgacactttcagcaattggaacaagggcatttgcccagtcaaccgcagaatcgccgcctccagagatgaccactcgctttcctgcaaatgtcttaagctcctgcactgtgtaataaaggtttgtcacttcataacggtctgcatgctcgatttcaagtttccgctgaacaggaataccgtggcccattgctaaaatgagggtcttcgtcaaatggcgatcaccattctcagctgtcagcaaaatgttctgatgttcatcgcgctcgaatgacgtgattttttgattcagtgcaatctctggttcaaatgttttcgcctgtgtttccagctgctgaatcaactgttcacctcttgttggcggcaaaccgcctacatcccaaatgaccttttcaggatacagtaggattttcccgccaaggctttcgttatactcaagtaccttcgtctttaaatcccgcatcccactataaaaggcggtgtacattcctgctggaccgccgccaataatggtgacgtcaaacaattcaagttgttctgtcatttgagtccctccagtttttcatcgattgatctatttataagtgatattgattctcattatcatatgtacctattgtagtctactctggtgaagggaatcaatagctttctgcaaaaaagaacaggacgagcgctttctcgtcctgtcctccatcacacaatcgttaatccaaggtcctttaattccagcgaaacaagtcttgcaatcgcatctgctccttcttttgtaaagtgcgtgcgatcctctatgcctgttgacagcataaagtaagaagtcgttttctctatgccggaaatttgataaaactgaaggcttgccgtatttaaatctacaagaaggacttcttcttcatcagctagttctttcatagcggcacagtaatcagggaaatcattgatatattctccgtctttttcatgaaagcggccaactggcgttaataaaagcggtgtagctcctttcgctcttgctccgtgaatatattgagacaaatagcttttatacgttgtgaaaggatctgtatgccgttcgggcttctccgttgaagcatcattgtgccccatttgtgtaaacagccagtccccaggctgaatgtcagccaatattttatcaagccgtccttcttcaatgaatgtttttgagcttcttccaccgattgcgcggttgtcgacgctcacaccctgcgctgtgtagcgatgtaaaaactctccccaccctccttgaacaggacgatctgggtaagatgaaacggttgaatcaccagctaaatagatggttgtcatgttcatacgccccctttttcatatagccactctaataagcgatgcggacatccaagtggctgctgaaaagatatgaaacaatcagcatcgctacttcattcattctctttttaatgatcaaaaccctgcttaccggtagatgtgaatacgttaaatatgcggcggaagttctatttttgtctcaacggcttgctttaacgcctgaagcatatagccaattcccttatatggagctagcggataaatcgctttctgatgaggaagtaataaaggatcgatcacctttcgatatttctttccacctagtatcactaattcatcatatgcagtgagatatttttcatgaaattgctgacttagtgcttctcttgttatctgatcagtatgcggtgtaccaaaagccacatcataattttcatgaataatatcatctgcctttaagaatccatgcttcgctgaaatgattaggtagtctgaaaagaatgtttgggcatagcttttcgtacgctgatgcagcggacttaaataaacgaggttcgccggctggctccctgcctctggatggacgtcccacattttcttcgccccacatggaatgatacaaactcgcttcacttgattttctccttccttcgttgatacatccgatacaacatacaacctagcgctgtgccaagtgtatttaagagaatatcatcaatatcgctgcttcttgtaatcataccagattgcgagaatatccattgaagcacttcaatcattgttgacaagaaaaagccagcaagaatcgccttttgccagcgcaaggttcggaatgcttgatagagaaaaaaaccaagtggcacaaataacaaaatgttccctgccaaatttaaaaaaacaagattgggatagccgtgatgataggcatggagattttgataaatggactgcaaaggcatgaggttgacactcacttgatcccttggtgcggaaaaacgattaggaaagaccgtcaaatacaataaaacattcgtatacataaacagacaggcaagaacgatttctgttcgtaaatagataaatcgtttgtgctttttcgcctgtctgtatctcatatgtagatagagcgggacgagcaagagaaaataagcaatggaaaacatcgcactgaatgtcatacggagagctgcccctttctcacatgatgcttgaccatatttacagcttattcaggcttgcctgcatctattcatcacttattctcctattcaatgacgagaaacccatattgacaaatcgtcatttttccgctaaactgactgacattcagtcatttaaggtcggtgatgatgtgtcgaaacgagaaaagattatgcttgctgccattggcgcgtttaaagaaaaaggaatcgaaaagacgaccatttcggatattgtgaaagcagcaggagtagcgcaaggaacgttttatttatattttccttcaaagctttccgtcatgcctgctatcgcagaacatcttatcgcacagatggtgcctgcgatcgaaaaggaattaactcagcatgcagatgtcctcgatcaagcagatgcgcttgttgaattcatcttctcttttacaagacaataccgtgacgtccttgctctgacctactcaggtttagcagccacggagcatttaaaggaatgggaagatatttatgagccgatttacaaatgggtcgctgcttttttagaaaaagcaaagcaggacaaaaaggtccgtgcgaatttgaactgtcaatatgcagccaaattcattatcggtttactggaatcgtctgctgagcaaatgtacttatttacagaaacagatacagaagaggttctgattcaaaagcgagaggtaaagcaatttctcctttacgcacttggcatagagacaccttaacttagtacagcacttgctgtacgctcttttttggtttcaaaatgacgaatcgtcagtttttagttttaggaggaaatacgatgaaaaaaagctggatgtatgtcgcactcacttgtttattcgaattactttgggtatttggtttaaataaagctgatgctgtgtgggagtgggcgatcattatctgcctgatcccgattgatttttattttttaatgaaagcctgcgagaagctgccgacaggcaccgtgtacgccgtgtttgccggagttggaacgattggtacgtctttgatggattatgcactgtttggcggttcgttttcattagaaaaactcttatttatgggtattttaattctcggcattattggactgaaagtgtctgatggagatgcacatgagcagaaaggagaagcggtataaatgggctggttttttgtgctgttagcctctgcctttgaaattggcggaaccattggtctcaatatgttcagtaagaaaaagcaaatcacgacaggcattttatttgttggcggatttgccctatcctttttgtttttatacgcctcgttctcttccgttcaagtatccgttgcctatacagtctggattggacttggaacggcgggctctgtcttgtttaatatgattctatttaaagagccgaaaaacatgattcgtatcctcagcttgctgctgattgtgattggcgtcgttgggctgaagttatttgcgtaattaaatcacaaaaaaggaagggatcaaagtcccttccttttttatttctcgtttaatggatatcttgctgctcgagcaagatacccattgcgtaaatcatttcgcctttttcatctaataaaaagtacacaatcaaaggttcgccaaaagctactgtttgctgcgtgaacaaaacacaggtgaatttttcgataccaattggaagctttctttttaatatagggtgaagaataggcgaagtccggattgtatctacatcaacatcccaacattcgttttttaaagttggataatgctctgataacaattggtgtaacatgtcggttgtgagcgttgcttttccatcgtacccatcatctattatgttggtgttatacatccgacggctgctcactttttgaagcattgattcgtattccttttaagacaaatcgtttctggccatcaagagtacaagtgatcaatgtcagttcatttttcccgcgatcctttagtacatcaacatccgtcggttcaattgtagctgagctgacaattttatattcgtatgttttcgcttgatgatgtaagacgactttttctcctttcggcacctcaggcagctgcctgaaaagccgatcgcctctataccctctatggcctgcaatcgtgaaattcccttcacctggcatttgatgagatttgatctgagttagtgcaatacctaaattttcttttgatgtaacaggaagcactttttcgtttaaatcaattgacgggatctctagctccattacatctcgaaggtcttcttctgacacagtgagatgtggaatagaagaaagggcatcactgtcattttcttctatcatctttaatgcctgttccattgccgctgtctcttgagaagttcgccactcatatataaaaggaacggagatgagcattagtcccgcgaccaccaaaaagctgcctaataaggttctttttttcattaatacactcgttccttccttttactgaatggttcttcttctaagaacaaggagaacagctccagatactattagtaaaatccctgcatacatcatataacgcagccattcttctccagtctttggcagctcaccgtttgagtcatggggcggatgttgatcccctttatctgaggctggaggattcgtgtggtcctcttcattcttcattggagcatttttcacaatcattgtcttgatctccacttcgcccatttgaattgtaaaagcgagtggtttttttaaagctacataaccatttggagctttcgtctctgtgagtgtatattcaccaggtttaagccctttgacaatggcttctccgtcttttcctgttgtcacagattttatcgtttttccagcttttgtacgaatatcaaaggctgcaccttttaaggttctatctgtctgctgatctacctttatgatacgcagacttcctaagatcaaatgattctttgctgttaattgaagtggcttctgctgatttttttcaattgtaaacaggatcggcttatgatccaattgatagccatgaggtgctttcgtttcaacgaattgatattctcccggttttagatcgttgatatgaagctttcctttttggtcggttacaagtgatttcttcaacgttttcccttctttactcagaagagcaaactctgcatgttcgagcgtatgtccctcatcatccactttggtcagttccactgctcccggcgtcagtttgttgatcatttctacttttgctggtttgtcttgacctaatcgaatcgtaaatgagacaggtgtctgatccaattcatagccggcaatgcttgctgtttcgacaaattggtaggttcctggcttcagttgatcgactgtcagttgaccgtttttgtctgtctttaagtctttcttcacacgctgaccgtgcgcatcaatcagttcaaaggtcacgccagcgagcaactgaccatcctccccttttttctcaagtttcacagcacttgtcgtccgaatattttcttttgtcactttcaccagttgatttggattgaaatcaatcttgaagtctactggttctgcatcaagttgatgtccaaaaggagccttcgtttcaaccaattggtaagcgcctggtttcaaatcgttgacagtgatgatgcctttttcgttggttgttaaacctgacatcaattctttaccatcgtcattgaaaagtgtaaattctgcgcctttcaatctttctttttcttcccctatttttgttagttctacagaacctttcttgagctgattgatggcctccacttgaatcaattctttttgacctaattcaacttcaaagacaagtggtgtcgcactcaattcatagccttcaagactctttctttcaacaaattgataggttccaggttttagacccgtgaaggtaatctttccatcctgattggttgtgattccttctcctcctgccactatttttcctttggcatcagatagatcaaagacaaccccttctaatgattttccatcttctccttttttgtgtaacagcactccacctgtagtgcggctattttcttttgtcacactgactagcttctcagggttaaatgggatagcaaaagtgacaggtgtttcgtcaagctcatgaccgaatggagccctcgtttcaacaaactgataggttccaggtttaagatcgttgacgatgatttccccgttttgatcagtgacaagacctgtttttatctcttttccatttgcatctacaagcttgaattctgctccttcaagcgcttcattcttttcaccaagcttcgtgagctggacagctccagttttgagatcattgatcactttgatctctgccggtgttttttgtgcgatttcgatggtaaacggataaggtttatttttcttttggtaaccatcaatactctctgtctctacaagctgatatttgcccggtttgaggttatcgaccaaaagcttcccatcttcatctgttgtcaaatctttacgtacaacttcgtcattttgatccgtgatttcaaatcgaacaccttgaagcttcttgccatcttccccttctttcatcacttctaatgcacttgtttcatataggttcttttgtgaaatgatgactggttctgttggatcgagtggtacttcaaatgtgattggtgtttcatctaatacataaccatcgggtgcttttgtttcaatgagctgatacgtacccggtcttagttcgcttatcgtgattttgccattttctcctgtgacgagcgaaccatttagctcatgtccgtcttgatctaagagcttgaactgtgcaccttctagtctctctccgccttcacctattttgctcaattcagcagagcctttgatgatgtcatttactgcagttacaatcgttgtttctgtttgattttctttaatggtgaacggccatttttgctgatttaattgatagcctttcggtgcgtttgtctccacaaaataataggaacctgggtcaagatgtttgaaaagaatttctcctttttcgtccgttttcaaatgggtttggacggtatccccagattcattttttagttcaaattctgcattctctaatgcagcacctgtctctttgtcttttttcgtgagcttgacatgctggcggatttcttggttctgcaccgtcatgctatttcctgttttcgcttgatctcctgattcgtaaggctgatcaattgtgacattgattggttctttcgtcttaatataaccatcaggtgctttctcttctgtcacgatatagtcaccatacagaagacgatcaaatcgaagagctccttcttcatctgttgtctttgttccaatgacgataccgctcgccgcatctgtcagagaaaagcttgctccttttagcgcttttccactactcgcatctacctttttaatggttaaagcgccaatcgctcctgtgccatctcccatgccagcggtacgtttgaccacaattgaggcttcggattcctttttaatttcttttacattttcacctctaaacgttacttcgttttgtagtgtacttcccaccttatctaaaatgagagattgatattctaaaatatatggtctcgtgatttcttctttaaatttgatttgaaaagaatctggatcgaattcaaggtctagctcataatccttccctttttccagctcttcctttttggtcacttgccccttttcatctattgtcgtcgaatacagatgaaatgagttttctattatggcttggttactgctcggatggtctataatcgtcgcatcttggactgttgattggccaaagttgatattcagtttccaatcaatgacttttccttgctgatttcctgatttgctcgtgtatttccctccatttggaatggacaccacagcattcacatctgattctttcgtctttccatcataaagggtcgctttattttcataggttttctgtactaaatccattccttcaacacttgtttgatacgtgattttgtatggagaatcaatggcatgtttgaaaatgacttcgaagcctgattctcccttttcattttcaaggaatttgatgtcataatgttctttcgctaatacctctatttcttccgctccattttccccgccttgtaaatcaagcgagtagacgatgattgaatctttaagcaaacgctgatttccttgaatgaaatcctcgattttcgcctcttctaaatgtttcaagttatagttcacaccgatattccatgtgatctcttttttctttgcatcatatgttccgttcttgaacccatttgactgcgtgtatgtgtcaggcgtgaagacagattgattttccttcgtcaaatccttgccatcttcatttacccattcaagctttacatgattttgcaggttcttttgatctttatctgctcttttttcataatcaaaagacgttgtatatgtgacggtatgttctgtcttgatttctttcataaattgaatatcaaaaccatttgcatgttcaacgatttgataatctgtgccttcctcaagcactgtattacctgtcgtcacttttaaactatctttttgcagcgtcaatccttcgtttgtaaacgtatcttttaatatcaggttgttcatggtttgttgatctttgttgaagacgatacgccatggaatggtcttgttcttgtaattcggtgttccatgatttttcgtcaggatttgctgatcaattctttgcttcccttgtttgctctctttaccagctgttacagtattgataatctcttcagcttcgaaaatccgctcggttgcttttgtttgatatgtgatgagataagccgattgaatatcttgattgaattgcaaggtaaacccgttttgttcatcctttttttgaggttgaaacacataatttccaaacgcttttgttcctgattctttaccatcctgatcaattgtgacttccttgacttgaaatgaatcagaaatcagcgcctgtgtgccattaaagaagtcttctaacaaagcatccttttcagcaatctttttttcgttatagttataacgaatttcccacgtaattgtttgtgtgactgggtcgtagtgggcggcttttttatttaaaggactgcctcttgtcacattcactgttccttctgctgaactaatcactttatcagcagagacaagggacgctttattacgaaacgcagactgatcttgattcgtaatgtccgtttcatacattaaacgataggctagatgcacgtcatctttaaattcaatcgtgaaatcttgaccatctgctgtttggccgattgtgtagtgattttcgtcaagcagctgaccaagtgatgtttcaccatttagctttgtatcaacacgataaagcttgattgaatctttctttaacgcttgaccttcttgaatcggatctaacagtttcgcttgtttcacatcgtctaagtccatattaaaatcgactgtccattgaatggtttcagcattgtaagatcgatttggttctccctttttcgagacgtttggaccatttggaatgtattgaatcgggatcgatatcgtatctttgccttcaatcggggtaatgaccacttctttttcttcagtaatgactgttttttgatctaattgcgtccacacttgaagtgttccatggatatttgaatattgtttaataaaatcagtgaattcgatggaggcatttccgctctcatctacagaaaaataaccaatggttgcctgattaaatttcatctcaagacgatcgattttttcataaatcactaattcctctggaaccttgaaatagaattcatccccgccattatagctatgaccatttgggatcgcccactcatagttaatggaaataagcgagttgatgtcaggcttatcaactgaatttccttcctgatcttcaaaaattaattttgcatcagtgagaagattttcttgtatttgcaattgttttgcaacactttgcaaccctacacgcttagatacgttcactttgttctttagtaattcatcttcatcgctttttttcgtttgagcagtttcttgattcttatcgtttttttcagatgaggttgagtcctcttttggaaggctttcttcaccctcattttgctttgttttctctttttgctcagctatactagtgacatcgatgtctattgatccttctaaatttggatcaagctcaacatcctctttcaatatgaccgtcacttcattttgttttgaaacggtatactcgccaacagatatgtcacccacagtaattagttccttctgctccttttctacctgtatgcctgcaggaagtgagagaacatacggaaattgcttttttagatcaattccttttatcgaccaatgaacaatggcctttctgacttgctgatcttccttgtttgataacttgtttccttcgctgtcagcaaactcaatatccccaaaaatattttcttgaatttctttggcctgtgctcctgctaaaggcaatattcccaatatacttgactgtatgactaacacggtgatgagagccaatgacaatatttttttcaatacatacacccttttctaaaattaattttcaacaacaataaaaaaacaatttggatactatctgataaatcactccgcttctgatcaaatatttttttaaaatagctccttaagaccctatgaataaaatgagttgatcaatcatgagcttgaaagggaatcatgagtagtggatatagtaagtatctggataggggtctatagaaatggggaatagtgagagggatcgtgaaaagaataaatgtgaatttttctatttatactggaatgaacaataaataatgtgtacatgcatatataagcatgtattcacatatggttcgttcatatgaaacaagcatgtatcatatggtatgtatggtgagacagttcagcatcatgtagatcgcattcctttctactccctttcatatggtaatcaaaaagctgctgcgttttattcttacatttaccgtttcaacagcaaaaaaataaacgaaatatctaaaatgatccatttttataggattcatggctcatttatcaccttttaaaagaaaaatatggagaatcaacgtataacatttgttttcgtctaatttttttctcttttatcatgaaaagtgaagacaaaacgatttagcctaaacattacaatcatttcatgcctattttgagaatcaaatgttctttaagtgaacttcataacatagaggcaatccaaggaaaggagttagttgtttgatggagctcattgataataaatcaaagagatggataaacattttaaaactgcttgtatccaaaaataagtggtggagccttcaagagatatctaatgaacatatcggttcggttcgtgccattcaaagcgatttagaacaaatgaaatcgttccaaacagaggacggagagccgttaatccacataaagccaagacaaggcatatccatttgttatacacagacgatacgagtcgactactatatcaaagaaattttaaaagatacgattgaaattcgattgattgacggcatttttttcgaacaaaacaggtctttctatgaatggatggacacgcttaatatcagtagatccacattgtataacaccattcataaaatcaattccattcttatctcttatgacattgagttacgcccagatagtatgcagttccatggaaatgagaaggagattcgtcaattctttgttgaatttttgtttgaagtgtatggaagccggctttggccattcgatgatattcaaaagcaagacgtagttgatttattacaggagctatttcaggtgcttgaagtcaatgtgccagatgtggcaatagataaatactgcctgtggtttgccgtctccattcaccgaatgaggaaaaatttcacaataagccgtaaatatacgtactcaatgaaagaggaaaaacaaaattctgcagccaaagggatctataatcaaatcaaaacatgggaagagcatatttgccgaatgaccaaagacgtatttgatgtgacgctggatcatcatgaatttgtctttttgctattgatcgaaccagctattggtcactttaaatcaattgaaactgtcgaagaaaaattgacgttctttcagtcacatacaccacgactctatgatgccattcattcatttatcaaccaattggagtcgatttttcatcaagaaatagcgaatcgcaaggtgatgacactcattcttctccaatattatgtgtattccaatgaaattaccgtaagagatgggttccttttcaaaaagaaatcgagctatttatcagaggtaaaaaaacagtttccttacttctattcgaggattactcatatcatccaagagttaaaaacagacgatatcctcggttcttttgtgaaaaatgaacgggaattgattcgtatcattacgtcttcatggagaggacttgttcatttggagatggaacggagaaacgcgctgaacatttttgttatttcaacattaggctattatcatagcttgtttattgctgatttaattaaattaagcgtgcctcctctcattcacattttcacaagtccagagaatacattaaatgatactacgatggatcaacttgggattgatatgattgtgactgatactgagcttccggttcaattcgggcggtctacgcttctgatcagctcttttccaacaaagaaagaattggacaacttgcaccgaagattggttgatatgatcgactaatgtatatcaaaaaaagctgctgaggagctctctagcagctttttgcttctgtattaatgaagcacgatttgttcattcatcaaatcaatggcataaagtgattgctcatattcatctaatagaaggtatactttgagtggtgcagcggtttgatcggtctgctgcgtgaataggacacaagtgaatttttcgaccccctctggcagcttgcttttcagaaaaggatgaagaataggagagattcgaagggtatcaacatcttttagccaaagttcatcttgtaacgcaggataatggtcaaccaaaaactgacgaaacacttccaatgtactcaaggtagatatcctcactttcttctatcatggcttcaagcttacctaaaacaaacatgtttaaagtcatcctatgatgccagtccatcaaatgttgtatactactagagacatgatttcatttttcttcaaatagcaatgtagatcaactttactgtcatgaggttttcatatgtatggcgtctactatattccaaccgatggacctatgatcatattcttatctgtttctttcgtgatgaaacgacaacttcctgctacaaaattccaaatttcttcaaaaaattggtgcattgagacaaaaaagaacagctcctcactgttctttcaaagaaaacacttcgccgctctctgcatcaacaccctcatggcaatcaagctttccgcacagaacatattgtttttgcgcttcgtcatagacgtagataggtgtaagttcaagacgttctctcaatttttcaaaggcttctttctgagttacagaaatttcacttgccgcttgagaggggctcagtatcccgcacacttgaaacatttcctttttatctatgtaatgaacggcttcaaacgagctggcgtcaatgaagaccttgatcttgtccataaacccactgccttcttgcccgttcgtttttaataccgcatggatgtatccatgatcacgatggagtgttttcagaacccacttccctgaatcctttggatatttttgcgccaagaaggttcggactgctttgatacactcggcttgctcttcttttgatatcgggaaggaatctggtgacggttccaatgagaaagcttgttcagctgaaatattctcatgaatgtctatttcttttttttcaaaggtattgtttaacggttcattccattcaatgaccttattcacatgtatacaatgcgtttcttcacgtccaatttcaaacggaatcgtgcctgttccatcgtttttcacataaatttcttctaacgcataaatagatcggattcggttgtgctcaaaggaaggccattgaaacagctgcacttgctgctcggctaaattctccagcttatcaagggaaagcgcatatttctcagctttcagtaatgttttggctaaaaatggaccgtggtgtgtaaagtacatgagctgtccatgttcatcccatttcacttcgattctgcctgaaggtgttactttcacaccatctattgcttcttcgaaagaaagttcccctttttccttctgatgcatataaaaatgctctccatagatcaaccctgtttcttgttcgatccattgaatgacatgggctggataaggtctcttaaacgtgacaccatgctgcgcataggttttgtccatgacaaaaataaccgattcgatctgtcctgtattcaaattcacttcaataacagcagtgccgtctgggttgacatcgtcatcctcaggttcagcttcatgagaggggaaccattccatattcaatgtataaatcgtttcattgaacatgttgacgtaacgataaaagctgtgtctttttagatcataaagatccaagccaaatttcgcctttgtctgatcgattagttgttgaatgtttgcattcatttgtttcacctcaaaatggttatgttttatggaagaacaaaggtgacaataaagccgactatgatgatcgctgataataatcctaaaaccaatgacatcatgtttgattcctttgtgaagccttttaactcaccttcagtcgatcggtcgatttttctaaagcgataaagcatgcttaaattaataaggactagagttacaaataataagaaaagtaaaagtataggttgtatgtttaagaatggattcgttacatcttggaaactaaatgactggagaaacatcagaccactcaataccactctcgaaatattttctaacctcttttctttctcccactcttcccctaatttttctttttcataaatggctatctgctcgaaaataggaatgaaagactttgttgagcctttctttataaaaccataaatacttagaaagagcatgataaatcctaaacaaagaaagaaatgtgtaaaccgaatgtcagacatttgaaacaagataaaaaaagcgaagatcatgatgcagactattaaattagagacagctatttggtttcttctcatctttttcagtgtagcttgttccatgtaatacccctctctgttttaaatgtttctgttgaacgctctatctttattacgattttactgaaaaaatgtttcaatattttccctttcaactgtcaattcggcttttttcgcaaatgaaagacgcccatcattcaatgaacgtcttatccttcttttgaaattagtacatcaattcttgagcagctgttctatcttttatttgttgagccgccatgtgtttaaagtcatcaatagacagctgtctagatgtcttttctccatgctgtctgatattcagtgttttttcttgcatttctgtatcgccaatgacagcgatataagggattttttgcatttgtgcttctctcattttatagccgagtttttcatcccgttcatcgattgtgactctgattccaatctttcttaattgctgctgcacctcaaggcagtggtcgaggtgaacctttgagacagggatgatttgtacttgtactggtgccagccataatgggaaggcacctgcaaaatgctcgatgagaataccaaggaaacgatcaagagaaccgaaaatggcactgtgaatcacaactggccgtaccttttcattcttttcattgatatatgttaaatcaaatttctcaggcatttgaaaatccagctggattgtggcgcactgatggctacgctgcaaggcatctttaatatgaaaatcgatcttcggaccataaaatgccccatctccttcatttagctggtaatcgacctttagccgatcaagcacattctttagcgctgattctgaaatatcccaaatggcatcatcccctaatgctttttctggacgagtggatagttccacagagtactcaaacccaaatgtccgatacacatgatcaactaattggaaaatccgtttgatttcagcttcaatttgatcttctctcaaaaaaatatgggcatcatcttggcaaaaagttctgaccctgaacaatccatttaatgcgccgctaaattcatgacgatgcacctgaccaaactcagccattctgatcggaaggtctctgtatgaaaataagctatttttaaacataagcatatggccaggacaattcatcggttttaaagcaaagcttgtatgatcaacttctgagaaatacatattttcattataatgatcccagtgacctgacttttcccatagctcttggttcatcataaacggtgtgctcacttcttcatattgcgctttgcttcgaacttctcttgaaaatgccattaattcatttctcacaagctgcccttttggtaagtaaaacggcatacctggcgcttcttctgaaaacatgaacagagataattgtttccctaatttccggtgatcacgtttgtttgcttcttctatgaaatgaagataattagctagttgttttggatgttgaaacgcgacaccatacactcgctgcaatacatcttgatgactatccccccgccaataagcccctgcaacacgtgttagcttaaatgactttacgaacccagtagaaggtaaatgaggaccgcggcataagtcgataaattcaccctgctgatacactgtgatggcctcttctgaggggagtcgttttaagatatctagcttatatggatcatgtgcaaacaacaattcagcttctttgtaagagacctcctttctttggatgagaagattctcgtttatgatctttgtcatctctttttcaattgcagccaaatcctctacacttaatgtttgattgagcttcatatcatagtaaaatccattttcgataacaggtccgattccaagtgtgacattgtcgtataaccttttcacagcttgggctaatacgtggcagatgtatggcgcagcacttcaagcccttcttttgaatcgagtgtgacaatagacagccgagcatcacaatccagctgatgactgacatcgaccatttgttcattgatctttcctgccactgctttcttccttaagcttgggctaatataggaggcaacatctgcgacagtcgtacctgcagagaactcctttatctttccgtctggaaattgaatcttcaccattttttctctcatgactgacacacctttcattttttgatataaaaaaacacactcatccctcataaagggacgaatgtgtaatccgtggttccacccaaattcccataacgcatattcgctttatggctctggtgccgtaacgtggcatagtcggtattggatacttcaattttccccaatacagctcaaaggcggtaagacaacttttctgcgttaggaagatttcagcgtgacttccctctctggtaaccgataaaagtggctcatgtccttttcaaagcaatgatcatagttgagtgaacaaaaaaacacacccatccctcataaagggacgaatgtgtaatccgtggttccacccaaattcccataatgcgtattcgctttatggctctggtgccgtaacgtggcgtagacgatattggatactatgatttccccaatacagctcaaaggtggtaagacacttttctgcgctaggaagatttcagcgtgacttccctctctggtaaccagtaaaaatggctcttgtccttttcttcgcttttaatttctccatatcttacatgaaggtgatggatcatgtaaagcattattttttgcagtgctaccgaaattcattctttaaatgatatgctgggtgtatttacttggactgtattcaatttgaaacgcagggaataaggctcgtttcacttcttcagtgatgcgctctccttcttgattgaatttcttttccatgtctgcaccatttagcaccaaatcatctgtctcttcgtcaaaccagcggccatactgtatgttccaattccagatcttcgagaaaagtgtatcgcttactggtacatcgtctctttctaaatgacattgacaatgcccacaatgaaaaggttcaccaccgtaatctccttcaattttcacgaaaggatgctccacaaattctcgacagcacacccattttttgaagtgctgaccgaactctgtcagtttaaacgagtaataatgcatggaagttcggctccctatcatgtcaaaaatcccttgatcaattaatgtcttaagtcgatactcaataaaatcatcgccgatatactgttctaaatgaccgatcacttctcctattaatcgtggcgttacgatgtactcctcttctggatgggactgatgaagccgctttgccattttcactaaataagcatcaaattcatcctctagtacgctgatcgtttgtcctttttgccatactctcagggtatggtgttctttagcaaataatagccattcgttttgtaatttctctctttcttcttttgacactgcgtgaatatgctctttacttctgtacaaaaccttcaatttttcagatgtgatttcccctgcatgtcgaatatccattcgtcttgtatttgtattgaacaacttgtcaaacgcagtcgttgtattaatgagagacaattcaatgtttttctcttttaataagtagatggcatatcgcaaaccaatttactcatgggcattattgcctatccagatgaggataagcgtactatctttgatatcttttatttgctgaatcattctatgctgatcgatgaccatgtcatcaaaatggccaaattcatttgacatcacgtgacgaagccactctatacgcttctcctgtccctcatgttcttgcaatttcagaagggggccaatcgaataaatgtcatgaaagacgatcatatcatttacttgctcttgcttcatttcgcagaatgcttgttttaaactaccggcagccgctgccccaaatacgatatgtatcattattcgtctccctttatcttacagtttatttcatcttcacctattcatggttcttgcgtcaattctattgagtcaatttcattcaaaagtatgacaatgagaagataagatatatagaatgcagaattgaagagactatatcccacgaaatggggctatatgtttgctgagctcgctttgagactttctctctgaatgattgattgatagaaatcctcttcattcagttcatgttcttatttacaaattccccttcacaatcgttctcttggctttcttcacaattctgctagttgcttttgtgtcagaatcctttgaccactggtcgcacaggttcgttacccaatttggttgtgttttactcgcgtcattgagccagtttcctacagaatcttgaacatatgaggatggatcggatttgagtaaatttagaatagggagtgccctctctggctcttgttttaataactcaatatgctttgtccatacccctctcggacggatcgactctacagagaaccggcgaatgttttcatcctcgctttttgcccattctgttaaatgctctatactttgatcaagctgaagacttagactttctctcactgacatccatgcaatttctcgaacaccaaaatgatgatcagctgcaaatggttgaatgtacgccagtttctcttttagtgttgataaactctgtttgttcatataagcagcccagcatcgaacgctatcagatacgtggtgagcaaatgcctgcagcactttcgcttgtttttcttcagtctcttcacgcagcacgtcatctaacaattgaccaatgagccgaatggctttcattcctgattcagctttttgtttagcgatctcagatgatacttcccctaaacgatggtctaaaccaatggacggcaaaacatgctgtattagcgtcatatgattgacagccagccattcagttaaattcacactttcgatctctccctgattcaaaaggttcaagacgtcatgagggatatcagttccctttcgagcgccttttcgattgatcatttcctcacttattggcattctgtattctctccttgtctacggcttagatattgacacctattgtagcaaataaacaacttcactggtgcattctttaaatcaaaaaggaactacccgaattaagtagttccttccatacaacattgaatgtcagttagcttccttgctcgatcaccttcaaactcttacgctgagaaaatcggccaaatgctaccattaaaatggtcataagtaaagcgagaaaaaccgtgccagcactgatccagcttaggtttaatatagatgtttcgcttagcacaaaccctcctacaccagagcctaaggcaaatccgaattgaataaatgatgtattgacacttaatgcgatatctggagattttggtacaagtgtgacaagatatagctgctgagctggtgatgtgctccatgtagcgatcatccatatcatgatgacagccaccataaccacgagattccctgtgacgaatgctagcagcatgagcatgatgatttgcaaaataattcctgtgaaaatcgtgaatattgggccttttttatctgctgccatccctccaaggctggagcccaaaaagctgcatattcccgctagtaacaaaatgccactgatttctgtgatgctcaggtttgctgatgcttgcaggaagggcgttaaataggtaaataacgtggaatatccacctacataaaatagcgtcactgccaccgcaagtaatatccgcttatcttttaaaatcgataactgcatacgaagcgtcaccggttcttgttctttcatagaggggattcgcttgtacacaacaatcagcggaataagcgtgatcaatccaatggctgcgaataatgctttccatccgattatactgcttagaaatgtcccgattggaacgcctaaaaccaaggagctgcttaatcccattaaaatgatgccaatagctgttcctcttttttcacgttctacaagacgagtcgcaacagccattgccactacaatagccgtccccccactgattccttgtaaaattcttgtcatcatcaccatttcaaacgaatggctgacacttgtgatgacattacttaaaataaaaatcatcagcatccatgacagtatttttttgcggtctatattgatggtcagtgcaatgacaatcggtgcgccgatggctgctgagagcgctaaagacgtgaccaataatccagcagcagacgtcgtgacatgtaaatcatttgcgaccatttggataatgcctgtaatgatatattcgattgttccaattaaaaaagctgctaatgcaagtaaataaacaacggttttattcttcatcgtgatgtttctcctttgggcaatgtttacgatttgatttcatctataatcggaatttgaatttcaatgagtctgccttcttcattttcagacagcgggtaataaatctctcggcccggctggtcttctttcacgcggtatccattattttcgatccatgtcgctaggtcaatacaagctgtttgtgcagatggagaatgggaatgaaataatagtgtcgccatagtctcttcagcaggtaacgtacgtatcgtgattccttgaggaagaatgccttttaacgctttgacggaataccctacctcaaattcgaactcactttccttttcgaatgattccctccatagcactacttgtggtcccgagatcgattcttgttgttgtttaagtaataaatgatgaaacgtttgaaagaatgagggaatctcatcaaccgttccgttcgattgaaaagacatgatgcatttgctttcaacagatttgatgatgacctcctgttctttttcaacacatccctctcgttgaatgaggtgcatccgttccttaatacgcgctaatttctgttgttctctctcgatcaattgctgaatctcactttctttcaagagaaacatgccctgaatttgctctactgagatatcttcacgaagaagctgccccatttgctttaacgtaaagcctaattccttatagagaaaaattcgattgacctcaagtaactgctcagctgagtaataacggtatcccgaatcttgatcgatctgctgaggctttaataaatcaatttggtcgtaataccttaaggttttgacaggcactttacttaacatagaaaaatcgccgatcttgaacatcctgcatctcctccgatttgttgatctgatcacagtataaacctttcagttaaggggaaggtcaacatgaagttgattaaatttttcaaaagcacgaaaaaacctagatttctctaacatctaggttttgctcattattctaaaattgttctaacaagcccatctcttccacaatctttatatcattcataaactgttgcaaacttactttgttctcttttttctgtaaatctgaagaataacctaagcatagattaaaaatacaatctaacctttcaccgactccgctaaaataataatttgtcagtactccactatgttcactttcaagaaccacaactgtagccatctctagtacatattcaatatcttctttagaaatcgttcgatcctttttcttagcattgataaattcataactatgaatagagcgtatcctaccttcaagtaaattgagtatagaccttttatagatgacatacacactgtgaatatcacttttatcaggacaatagggatcttgtaaaatgaattttatacgctcatcttctttttccatttttattgcatcaagatcatttaataaaatggaatcaatttcttctattttcataggacgaaaagtgttgactgcatgtgttttacttttcatttgatgaatccaaacaatccaatctttccaggcactttacaatagctccgcttttaaagaaattgaggatgacaccctcgctaaatcgttcggctttcacaacctccatcataagagcaagcacgcactgcgcatttaaatttgagatgtccacgttctccatatcgttcagtcccgattcaatcccattttctttcaggatttctctgtagcggataagctccatctcttcatgttgttctgcaaaggtataaatatctgcaatcaagtgacggaccgtttcggaataattcacaaagggcatctgaatcggatgttcaactgtaccatcattttcttgatcgatgacccattccccaataggatcttcctgaagcagcggtatgtattttgttagaatatcaaattggctcattctcattctcctctatttcattgatatggttcactttgtttctcccgatttcatcaagtattttactagtgagattatttagccacgctggccttcctcaaaccttttatttacctcatactctcatctgctttatgaccaatgctgctgtttcactcggatggctaagaggaaaatgatgaccatatggaacaaagtcaatcttaccaagatgcgatggggcagaatagcctttgtcataagtcccccaaatgatatgaagatgatcctttgtgacctcattgaaatcatcttgattggctttctgttgtagtaagctgttaagctgaaccgtcgtatttaatattctaggagacgtaaaactatttctgactttttcaatataatgttcagggatgctctccgtattttcaaacaaaccagtccttaagacataacgccctatcatattagtcgatgcccatttcaatgtccatttgttcataaattgaggaacatttcgtgatgcagcatttttcttatgaataggcggctgaagtaaagtgattgaatacttctgatcgatgtactcttgtaccaatgcttccagaagaatatatgcaccgaatgaatggccaattagatgtgcaccattcgccgctttctccaataccttttttacgacattcaaatagatatctagaagatgtttctctcgtttaaaaggagaacgtcccaaacctggaagatccaagatccatacaggttgattcgttttttcatgcagttcttgtgctaaagggaataaatcctctccatcactcaacaaaccatgtaataaaataaacggcttcccctctccttgtaattggtaaagggtcgtgttatcacatagtgttcgtttaaataaatgatcatccttaccgtttggattcatcattcgataatccagatcagctactacagcagggaaaaatttcatgacacttgtcttctgaaaccaaccttctcccattatttttttcactgcaacatttgaaaacgttctttttgtcataaagttcaatccatcagaaggaatgtttgtgattttacttacgccactattcatcatagctttcatcaatggtattgggacagatatttttggtgccctcatattcatactttctgacatcacactcaataattcaccaatattctgatcgcgctgccagtcttcaacaagcgtatatgtttgaatagccggttgctccaatttgaaaacctgcacaataaacctagcaaactcatcgtttgaaataagtggcagcctatagtccttacctccaggaatcaccggcatgagccctcttcgcatactcttcacaagcaagcctactcctgctatttgctctgtactccccgtttggctactaccgacgacagttggcggattaatgacagacagcggataacctactgctgatgcctgttgacgaatataaagatctgctaaaaattttgttctctcatatggattttttattttcaaatagctgtttccttctttaaacacatcaatttcaaccttgctattttgatcatcaaagggactcatataaccgacaacatgaataaattgctgcaagcccttcaattgatgaatacttttagctaactcactcatatgtttggcgccatttaaaaagacggaagcggcctctttacttgtcgcttgaatatccatgggtcctcctgcgtgaatgatcacatccgttttcaataccttttccttatcttcagcacttaaacccaattcgacttttgtcaaatcaccttcaacaaagtgcatcactgcctcttttaagatgcctctttcttgaaaagtgcgtgttgctttactttttgaccttactaaaagaagaatgttcacatcctctttggctaattcttttactaactcctttccaataaagcctgttccaccaattaaaaatactgttttcatatgaagtctcctttttagtactattcagtactaatttgatgtaaaaaaaatgcttcttttatcgaagcaagttaaataaatgatctgctgtttttgtgatgacagtggcatccttcaatgtttctgaaataaataatgcgccttcaagattggtaataaatagggatgcaacctcatcaatatgaatcgtctttctgaattccccgttctctactccttgtttcagtaatagagaaaccttcttttgtaatcctgtaaaaaacagtcctattttttctttaatttgcgtagcctgtgtaggactttgaatataaagagtaataaatggacagctccccttatagtctctcgattgaactccttgtgataattgctttaaaaacagttggatacgttcttcaactaaaaattggttctcagataatacatcatcaatggcggattgatacatgtcaatccaataatcaacgaccccttctaataattcctccttattagaaaagtgataatacacattagactttgacactttgcttacacgtactaattcatccatgcttgtataagcaaatcctttttctaaaaataatgttgcagctacttcaagcacacgtttttgattcattaattttacttttttcataattagaactatatagtactaatttaaatatggcaagtgtttatttcatttagaaaaaagtctgatgaaagaaatgccccaaaactaaaaaagctcgaaaatctaatatgattttcgagccttgattaaagtctattttttcacgagagatacaacagtctccacatgactagtatgcgggaacatatcgactggctgcatgtattcgattttgtagtcttttgacatgtattcgaggtcttttgctagtgttgatgggttgcaagagacgtagacaagacgttttggttggacttgtttgacggtgtctaagaaggtgcgctcacagcctgttcttggcgggtccacgacgatgacgtcaggacggaagccttctttgacccattttggcagccaatgttcagctgttcctgtcacataggtcgcgtttttcatgccgtgttttttagcatttttcttggcatcatcaatcgattctttgatgacatccattcctcgtacttctttggcgccatctgaaagccacatcccaatcgtcccaacgccgcaatacgcatcgacaactttttctttgccagtcagctttgccgcttttttcgcttcgtcgtaaagctttagcgtttgcttcggattcaattggaagaaagcacgtgcactcagttcgaaggagacgtctcctaaaaattcttgaatgaccatgttgccagctaggtgagatgtcttatggccaaagatgaccgacgttttttcaccattgatgttgtgcataatggacgtcacttctggcaaacgtttttgaatggcttcggcaatttctcttttctttggaaattcaggttttgatgtgactagaacgacctgtacttcacctgtttcaaaaccgacacgcacaacaattgagcgtacatcgccttttctcgtccgttcattgtagaccgatacaccgaatttctctaaaattttgcggacaacgcccgttgttttgttcgtttttggatgctgcacgatgcattccttgatcggtacaagcttatgagagttcagtccgtaaagccctgcaatgatgtcaccgctatgagaacgccctacttgaaactgacttttatttcggtagtgccatggatcttccataccgatcgtcggcctgatatcaagctgttcaactggtagttttgtatgtcgttccattgattgaatgacaatatctcgtttttcccttagctgctgctcatacgccaaatgctgaagctgacagcctccgcactcttcgtatactgggcatggcggtttcactcgatgctcggaacgctttcttacttttctaaccgtaccttctgcatattttgcttggacattcgttgcttccacaaccacttcttcgcctggaagcgcacctgggacaaagaccacttgctttttaaaatacccgaccccttccccattaatgccaaggcgtttaatggtaagcggaaactgctgtcccttttgcaaaagggcactttgctgtttttccttcacttcattctctccgttctatctgaacccttgataggttgtcttcattttattccatctcattagtataccatgacttggacaaagagagaaaatccctttcatttatctgtctcaatgcttctccataaatataaagatgcgtagcttaaatagggagtccactccttgcttaacactgccatctcttcttttgtcggcttttcaggcaggtcaaaatgacgcttgatggcgttttgaatcccgatatctgccatcggaaagagatttggtcttccaagtccattcatgagcacattttgaactgtccaaggtccaatccctctaattggaagcagacgttcttccacctccagatcagttaattcgtgtaattcttctaagcaaagagagccgctcacaattcgctttgagacatcgatgacatattccgcttttcgctcactaaattggagctttctcaattcctctgtttcaagtgaggcgatggtttctggtaaaggatcaaaccaaaccccctctatttgctcgccgtacgtatgaacaaaccgttttgtgagttcataagcaaacgccagattaagctgctgatgaatgatgcatttcatcaagcaatgatataaatgaaaatccagcatgagaggtgtccccttatgacgctcaaaaacaggtgctagatttgtttgagaaaaatgctcatgcacagcgtctaattgatgctccatgccaaatattcgtttcacctcacagatgagaggtttctcaggaccatttcctttcacccgaaacgtgggcgcttcttttgttccggtggctcgaacgacgacaacgtatggtgtttgttctaatctgatgggtactttgatctctcttttatttaaatcgactgcttttaatggatcatttgataagcgacgcagcacttgatcaaagtgatatggcggttcaacggtcagctctttttcccacatattttcctcttcctttctgcaaacacgcagatgcgattgtttcactttgcatgaatgattctctatattgaatactttctaacataaagagtacaagaatttatcagttatatcttccttatttccggtcattttccttttggatgaaggaacatttttagtcgaattcagctaaaattcgacagcacccttcatgattttaggttcattttccttaaattagaaatagaccctctgggtgatagcttctatcttgaaaatatttgtataattatgacatatcgaggaggtgaacaagggaattagctgattaggcaatcatttgttttatctagcaggaacatattttacctcattgatcaccggcttcacctagtttcactttttacgaaaaggaagacccaaactttttttaaaaaaggagatctgaccaatgaaaaaaaccattctttctattgcccttgccactgctgtttcttcgacactaccagtattcgctgacgctgcggagaaaaaaacgtcagcacccgtctctactacactacagcaaactgtattaaacaaagcggctgaaggaaaagctggaacgacagctagtcctaatgttaacgtcaacttcgatgttcttggaattgccaatgccattgtgaacgcagtaaacgcaaatgccaaccgttctggattcgttaagagcgtgatggaaagcacattctatgctgctggcggcagatataatgtcatggtctttaacctcagccagaactatgaagaccgttttaatggcgtgaaaacttttgctactgctaatcttggcaatgtcgtttatggtatttgggtatttgaaagcggcacctttaaaaacaacggtgatggcggctgggataactgggcgttcagaggctggtttgaccgtcaagataaatttgttacgttccatcgtccttaattctcggttttatccatcaatcatacacgcacattggaccgatctcagtgatgagatcggctttttttatgcagaacacgtataagttcaccggtgctgcttcatgatataatgcaagtctggaggggtgcacatgctgaagaaaattgcagtgacaaaaaacggcgacttgattgaacatgcaacattgcagcagctttcaagccccgatatcgcctggtattggattgattttcatgcgcctacggaaaaggaagccgcgcttttgaaggaatactttcaattccatccgcttgcgattgaagattgcttccattatttacagcggccgaagcttgatttttatgaaggctatttatttttcgtgcttcatgctctgaatcaaaaaacgcttcgatctgaggaaatcgatctgtttgttggtgacaattatattgtgacctttcatttgaaggaagcgccatacattgaccgtgtcattcgaaaactcaaagaatctgataaagcccgaaacagcgggcctgagcatatcgcctacatgttgattgatcagcttgttgatgattatttccctattatttatcaaatagaggacaggctgaatgaaatcgaggatgaagaaggtcataaaacatatggaacattgatgaacgaagtattcgggattcgatccgatttgctcaaactgcgaagaacgattatcccgatgagggaccttttatatcgtattgtcaacacgcatatgatgagaagtgatacgaaccggcaagcatactttaatgatatttatgatcaccttttgaaactaaccgagattgttgaatcaaaccgtgatatgacagccgatttacgagacagctatcagacgctgaattctaatcgaatgaatgcgatcatgatgacattgaccattgtgtcgaccatctttattccactgacctttattgttggggtgtacggaatgaactttgataacatgcctgaattacactggaagtatggctattttggcgtactgattttcatgggtctgctcgtctcgggtatgcttttgtggtttaagcataaaggatggttccacatattcaaataatgtgtagagagaatggctgaggaggcggttagatgaaaaactggattccattgtctcatcaagaacgaaagctcgtatgggagacgctctatcgagatttcaaatttcatccgagtctctctcgtttcccctcatttcgggtaccttctcctttcgttacatatgatatttctgcttattttgaggactcttcccttctacatgctgatgaagaccttgaagagaaagcattacttgtttttcaggagcttatcagaacagacgaatatatgctggcacttgattggcagcacgaatgctactggatcacaccatacggctcatttgaaaaagatgaatttggagaatggacagtgcctgtgcttccgaacggggattattatttctttttatcaaaagagatgcattggggcttgctaggacatccttgggagcaaagtatcacaatttttggtgagggcttgattgattctttctcacgccatcatccgattttgtttcagcgtaaaataagagaaggataaagaaaaagctcgcaggtgttctgcaagctttttttctatagctgagggagatgccatactttttcaagcatgagatcgtctaggcttttaaaggcataaccttgttttttcagtgccgtgatggcatcatccaatgcctcggcattgtcccttgagacggtatgaagtaagtaaatggcacctgggtgcgcctgcttcatcatttgatcgtaagcatactgttttcctttttgatgatggatatgccagtccacaaacgccactgaccaaaaaacggtttgatagccgagctcttttgtttccttcagcactctttcactgaatacaccgcgcggcggacgaagatagaggttgtcttgttttccagtgattttgtacacggcttcattgacacgcccaagctcttctttgatttctttcgtactctttgttgtcagatctggatggtgataggaatggttgccgatgatatgaccttcctctgccatacgtttgacgagctccggctggtccttaacaaagtgtcctgtcacaaagaaagtgcctggtacttgatgttttttcagcacatctaagatcttcggcgtgtacccattttcatagccattgtcaaatgtaaaatagatctctttctttttcgtgtttcctaaatagaaggcatcatacttttttaaaagggcgttcagttctttacccgcatctgccggcttatgttctttgcttttcgcaaatccccaatggacaggctgattagacacggcttccgcttctgagagaggcatagatacaaaaagcgcacataaacagatgagcatgtattttttcatttacgtcacttcccggtttttcttctattgtgcagaataagaccgagactcatacactgattcacctgccaatttaaagaaaaaagcccgcactgtgcgagctattcttccttccaatcatttttaaaccgttcatatttcgcttctaggtcgtcaatcatctggatcagtctgtctatatcctcaacatctgttgattcaggatctaatgaatcaatcacattcataaacatatctaatcggttctttaaataatcaacctgctgctctttgctgtctgctgccttgcccatagatacactccctttagcatttgtttctagcttatctttttttcccttgtaaatcaatgaaaccccacttgcgtataacggtgatggggcttaaaattaactgttggcgggtccacgtttgcccgaatgaaaaggagatagataccatgaaccaaaaaacagcacttcgtccgattacacctgcatatgacccttgggaagcctatctcgatgtgcaggactacggagagatgaagctgacaaatattgaatttacaaccacgacgttgtgtaacatgagatgtgagcactgcgcggtcggctatactttgcagcctaaagacccgaatgcactgccgcttgatttactgcttcgccgtttagatgaagttccgcttctgcgctcaatcagtattacaggcggagagccgatgctttctctcaaatctgtgcgggaatatgtcgtccctttattaaagtatgcccatgaacgcggcgtccgtacacagatcaactcaaacttaacgcttgatttggcgcgatatgaagaaattattccatacttagatgtccttcacatctcacataactggggaactgtcgaagagtttgcaacggtcggttttgcgatgatggatagaaaaccaacttttgaacagcgcgagaaattatttaaccgcatgattgaaaatagccgggcacttgtcaaagcaggtgtgaccgtatctgctgaaaccatgcttaataagcgtacgcttccatatattgaacacatccaccggcaaattgtggaggagatgaaatgccagcgccacgaagttcacccgatgtacccaagtgattttgccagcgcccttgaatcattgacgcttccgcaaatgcgtgatgcgattcatcaactgcttgatattcgtgatcaagacacatggatgctgtttggcaccctgccattttattcttgcagcacagatgaagaagaccagcgcctcctcaaacgattgcgtcaggagaaacatgtcacggtacgaaatgaccctgatggacgctcacggctgaatgtgaatatttttgatgggaatattattgtgacagactttggtgatacaccgccgctaggaaatattgctactgatacattgcaatccgcgtatactcgctggatggacacaaaattagcaaaagagctgaattgtcattgtccaagcgtacaatgccttggtccgaatgttcttgtgaaaaacagctattatcaagatgttgattttacttctcgtacagccagggggtaaccgatagatggacgatacttttctgacagtagtcaagaacaaatacattgaaattctccttgttggactcgtactttggcttgccgtctttttgattaacaaagcgcttcaattgttctttaaacgaacagagtttatagaagacaagaagaaaaaaacgatcgagagcttggtcaaatctgtttcaaaatacaccgcttcgatttgctttgtattgtatgtcatttctctcttctttcatgatttcggaaaaattcttgcaggtgctggtgtggctgggatcgtcatcggttttggcgcccagacgctgattcgcgatattttagcaggcatttttctcatctatgaacgtcaaattcataaaggggattatgtgacagtgaataacctctttaatggaacgattgaagaaattggtctccgatctctgcaaattagggaatggagcggcaagctgttaaccatttctaacggagacatccggcaaatccaaaactataacatgcactacatgcggattacggaatctgtattaattagtgcgaatcaaaacccagacacagcctttcaagcactcgaaacggcctgtgacaatttaaatcaaatgcaccatgattttctcaaaaaagatgaattccagcatgccatcgaaccgtttcaagttcatggcattatgggtctgaacaagctgaaccgcgggattgagatcacagtgaaaggaatggtcgaagacgaaaaatacttcgatgctgccctcgctgtccgaaaagaaatgatcaaacaacttcatcagcatgatgtcaaattgcttgaagatctcgtctatccccagcctgcaaaataacctcatttgtgatggggttatttttttgattgttttttgttaactagttaacaaaaaagaaaggatgttgattcatgacaaaaaaagaggcgctatcatttattaaagagatgtatgaagaggtgttaaccaaattcaatataaaaaaagtgaaggcatatttttcacctgaatatcagcaagagacagatggagaggtttcgagacttgatgagtttaaaaagcatctatccacattaaaaggattgacaaaacagcttgagatccccgcttttcatgatgtgttatttgatgaagaggcgcagcaagggtgttttcgttacacggtacatgtggaactcgcaagcggagacaggggttttattgatgtcatggctcttttcacgttattagatggaaagatcattcgatgcgatgaactgacgcgggctcatgaaaaaaatgaaacgtttgaacagcttggacacatcagctaagaaatctcttcagtcagcccctctaacttctatcctcttgactaattcatgtataatagaaaatagattgatttcatgcagcatggggaccctcatactgtgtattttctaagtgaaagagagtgaataagatgggtcgtaagtggaacaacattaaagaaaagaaagcatcaaaggatgccagtacaagtcgtatttacgcaaaattcgggcgtgaaatctatgtggctgccaaacaaggtgagccaaacccagaatcaaaccaagcacttcgttttgtcctagaacgtgcaaaaacatatagtgtcccaaaacacatcgtggaccgtgccattgaaaaagccaaaggcggtgcggaagagaatttcgatgagctgcgctacgaaggatttggtccaaacggatcaatggtgatcgttgatgccctcaccaataacgtgaaccgcacagcgtcagatgttcgtgcggctttcggaaaaaatggtggaaacatgggcgtaagcggctctgttgcctacatgtttgaccaaacagctgtcatcggtgtcgaaggaaaaaatgaagaagaaacgcttgagcttttaatggaagcagacgttgatgtacgtgacatcatggaagaagatgaaacggtgattgtgtacgctgaaccagatcaattccatcaagtacaagaagcattcaaacaagccggcgtagaagaattcactgtcgctgaaatcacaatgcttcctcaaaatgaagtgacattagatgatgaatctaaagaacaattcgagaaactaatcgatgtattagaagagcttgaagacgtgcagcaggtttatcataatgtagatttaggggaataaaaattgaagccatagtcgtggttgagttcattcaactgctgctacggcttttttattttctgaaagacatgtaatatatagataaaatgttcatttctacaactttccaaggagctgagcttcaactttaaaacatggtggttttcttattatggatttatgatcattcctattattgggctaagttttgttttcagcaactttatgatagtaacaaaaatgattttctttctctacatcgcgtggtatctatatcaaatctttaacttttacataaatgaactgaagagaaaaaaagagaaaccgtattagcaaaaaaaacagtcatctcccctattgataagaggagatgactgttttaattcatcccttgaaacccaaacgtcaggtgatcctgcacaggaatccaagcaccgattccttgtgaggtcacgtttttcacgacgagtttgcgtttatttcctttaagcacaaggtacacttctccgtatgtcacctttcctttttcattaatcgctggtgcataggcatgaagcgatgctgcttttttcggagagacgtggtatgactgatctcgctttgttcctgcgccaatcacggtgtcaaaagcgaggggcagctttgtcttttgaatggctttttgcatcatcaatgtttttacatcttctgggcttggcacctttgctgtgagcccgccgctcacttttacttgctgcttttgaacgtacttgccaatggctgttttggtgccgcctctgttatcaatgtgatttgtattcacttttttgtattcccagttggccaccgtttcgtttgaatcgtagctcagtgcccatcttccaaggaaaatggtcgcacggtaaccaacagctaatggcgtccctgaaatactggattcattcagcattttgatcaaatgggtattctcaatcggcacatctgttgttttaaacaattcggctgtcagctcgctcggctggagcaatggctgatcctgtgacgcattcggatacgtattctccttagaaatactagcgacagacgatggcaccttaaatggtttcgccgcctccgctggaaaactgtatagaaaacttaaggataagagaacaacaaacatgatgcggggcatctttttcatatcatcactctttctcattcatttttccatagtattttccgcaaagtcgtcccttatccacaaaagattataaaaggaaaaatccaatcgccataatgaaataggcagcaagtaatgtggcgccttcaaaccaattggtatctccgtcattagataaaatgactgtgagtaatacagcggacgccatggcaatgagctctggtaaggagaaaatgagcggcatttgcgtattgaaaaaaagcgagctgatgacaaggattggtgccaccatcatcgccacctgaagcgtggaaccaaaagcgatttccactgcgacatccattttgtttttatacgccatgataacagcagaggcatgttctgcggcattgccgacgatggccacaataatgactccgataaacagctcactccagccaaattgcttccctaccgtatcaaatgtatggacgaggcgctctgaaatgtacgcaacggccatcgttgcaagcagcaaaatcaaagtcgcaaactttccagaccattcaggtgtttcttcttccgtctctgcttcgccttccatgctctcctgcttagcaacatacaccccgcggtggctgaccagtttgaaatagagcgccgcgacataaagcaaaatcatgacaatactgatcccaatgcttaaaacaaactgtttattctctgccatctccaccgaaaacacttctggaatgacaaacgccacaataatggcaaacatgagcaagcctgagttgtgccttgcatcgtggacattgaacacttggcgcttatattttaaaccgccaacgaaaaaagacagccccgccacaagcagtaagtttccgatcactgatccagttaatgatgcaaggacgatggctgtcagtccttgctttaatgcaaaaaacgaaataattaactccaccgcatttccaaatgtggcgtttaaaagcccgccaattctggggcccgctatgatggcaagactttctgtggctcttcccataaaactagcaagaccaataatcgcgatacaatacacagcaaacatgataacctgcggaaaatgaagaaaactgccaatcaccgatagcggtacaccaattgcgacaatcacaagaaacaaacgattcatacagccattctcctttacatatgtctgactgttattctttcgtgagtgccggcatcatatacatgttagatttgcgcgtgtgagaaggtgatatcaatacttcctttcacggactgcaccatagagcaatgcttcaatgcaagggtgatcactttatcgatttgttcatcagatgtattaatgtcttcaaataagatatgtaaatgaatgctggaaatcttgtttacagctcctgcccttgtcgtttcaggtgtgatcgtcagcccttcacaagatattcgctttttccggcaaacatgaatgagcatttctccaaaacagccagcaatagctgaggtgaataattgagatggcctgtaccccgtttttacattgcctgatatatgcagctgcccttcatctattctcgcgatccatcgatccgtttcgtatctcagtttcattccttttccacctttctattgaaacccctatggttccattgtacgatgaaaatatgaacttgtaaggagcttcttatgtcgagaattcactttatgattttaattttacttgtatctgtatcaggtttttcgcagggagcgttactgcctgtcatttcgattatttttgaacatgccgggacttctcctacgttaaacggactgcatgccacaggcttatatctcggtgtactgcttgcgtctccttttatggaagcaccgcttcgaaggtttggatttaagccgttaatcgtgattggcggcgctgctgtctttttaagcttgttcagctttgttttttttgaatcttatgttgtctggttcttcctgcggcttatgatcgggattggtgaccatatgctgcatttctctacacagacttgggtgacctatgcgtcgtcatcgagaaaccgcgggcgaaatatttcattgtatgggttatcttttggacttggttttgccgctggaccttttttaacaccactcattgaaatcaatccatctttacctttcattgtttctggtgctgttagcttatgtatttggctgcttgtttttgttttgaaaaatacatatccagatagtggcgaagtgcagacgtcagagcagacaaacagtttgaagcgctttaagaaagcctttcaatttggctgggtcgcctttatgatgccgttttgctatggatttttagaaacgacgcttaatagtaacttccctgtatatgcgctaagaagcggggtgacagtagatgcggttgcgtttattttacctgcgtttgccattgggagcattgtctttcagcttcctcttgggatgctcagcgaccggtttggcagacgccgcatcattttatgtgtcacactcgttggatctttctttttcctactagcaggaatattcattcaatccgttttggctgttgcgatttgtttctttattgccggaatggctgtaggctctaccttctcacttggcatcagctatatgaccgacttattgccaaagcatctgctgcctgctggaaatttgatgtgcgggatggcgtttagtgcgggaagtattctcggtcctgttctcggtggaatctttgtgcaaacgtttgaaggtatgaatttactttaccttgtcagcatcgtgatattattcgtgtttttctgcgttcgattcggacggacggcggcagttcttgaaaactccaatgaagccatttctaaataaaaactcctctgcacccatgcagaggagttttttttcatttaatgatatccattttgtccgttcgcactgccgcttgttttgttcttaggttgatggcctttgttttgttttgtattgcttccgccttttttcgattgtttggacatatgtgatttcccccatccattcagtttgaacttgatcgttcttctgtaggatgcccggatttcattatagtttgcctggtacgattttacgcttatgtaaaagcgcattgagctcgccgccaaggataatcatgatgccggttaaataaaaccagatcattaaaataatgattcccccaatacttccgtacatcgcactgtagttggcaaactcgcctacgtaaaatgaaaatagcatgctgaccaaaatccatccaatcgatgcaaaaatggcacctggcagaacaaattttaatttcagcctgatgtttggagcaaaatagtataaggatgtaaaaacaatcaataaaatgagcgggctaatgatccatctcatcgcagtccatacagtgagaaaggcatctgacttcccaactaatttagcgacgaataaaccaagttctttgccaaagacaggcagcatcagggcaaaaataatggtcaaaaccatcgcaatcgttaaaatgatcgatgttaaacgtacgagaatgaaggaacgattctcctcaacttcgtaagcatggttaaatgctctaacgacggcattaatgccgttagatgctgaccaaagcgcggcaataatcccgaacgacaataacccgccgttccgattattcagcgtctgttcggcgatggattcaatcatcgaaagcgctccttctggcgcatagccagaaatgacgctcaggacatcctttgacgtcagcggcaaatacccaacgagtgtcagtacgaagatgagaaacggaaataatgaaagcaaaaagaaataggcaagctcagcagattttgccggtccttcatgcagcaaaaagcgttcaattaacgctttaataaaacccatacgcctcatctccaatgatcaatctgtctgtttcgattgaaagtgatcctttgtttcttcaataatttctaatacccttggtgttgtttcctttaactgattgacctgttcatttaaaaatgacaaatcatctgagactgttcgcatcagttgcttcgtttcttccatcttttctttcatgcaagctgatattctgcctggctcttggcagacctcttccagcttttgctggcagtcattccatttgtctttgagtgcaattcttgttggtcgatgaaataaagtcagcaatgcgccgcaagcggcacctaagagagctcctcggagcacgatttgatttttttcttccatctcgtctgatctcctttcagttaaaggtggttctctttctttacatacgtcaaaaaacggtcaattcctgtttcaattaattcatggacttcctcaaagttcccagtgtaataaggatctggcacatcatctcgatcgtcgtcttctacaaaatcaagaagacggccaataaagtgatgtttcccatagccggctatactgcgcagtgcccctacattttcagcatccatcgcaatgatatagtcgtatgttgtgatgtcttcatccatgatttgtcttgcggacattccttcatagctgatgcctttttcatcaagcagctttcgcgttccttcatgcgggggactgccttgatgccatccgccaatacctgctgaatcaatcacaaagtgctcgctaagcccctcatcttctactttttttctaaacatggcctctgccatcggtgacctgcaaatattgccaagacacacgaacaacacatgaatcatccttcattctcctcctatcttttccctaagagttcttttcgaaaaccttttctctatcatatcaactcccttttcttttggaaactttgcaagaaaagctctcatcgccattgacaaaatacacaaaaacaggagaaactttaggagaattacacaaacaaagggggatattagatgggaataattgagcagtttgtcacaacgatgaacaattttttgtgggggcctcccctgttgattttaattgttggtactggaatatacctcacctttcgcgttctcttcattcaaattagattacttccttattctttaaagctcgctttttcaaaacaagacaaaatgtcagaaggagatatttcccatttccaagcattaatgacggctctcgctgcaactgtcggtacaggaaatatcgtaggtgtggcctcggctgttattgcgggtggtcctggtgcagtattctggatgtggtttgctgcatttttcgggatggccaccaaatttgccgaagctgttcttgctgtgaaatacagggtcaaaaacgaaaaaggcgaaatgtctggcggacctatgtattatttagagcacgggttaaaacagaaatggctaggggtgctatttgctgttttcggtgccagtgctgcctttgggatcggcaacctagtacagtctaattccatctcaggcgttatgaattctacttttcaaattccaacatgggtaacaggtatcattattacagcttttacagcacttgtgattttaggcggaattaaaagcattggacgggtcacatctatttttgtaccggtcatggctttattttacgtcatttgcggtctgatcattcttgttatgaatgctgatcttgttccaggcgcagtcggtcttattttctcagatgcctttaccggtcaagccgtggcaggtggtgcaattgggactgtcattcgctggggtgtggcacgaggagtattttccaatgaagcaggtcttgggtcagcaccaattgctgctgcggctgcgaaaacggatatgcctgcccgtcaagctctcgtctctatgacgcaagtgtttattgatacaatcattgtttgttctatcactggcattaccattgtcatggcagatatgtatttaacagtgaaaagtgatgcgctgacctcgttatcctttgctcacttcctcggtccagctggctcaaccattgtggcaatcgggctgctcttgtttgcctattccaccatcattggctggtcctattatggcgaaaaatgctttacatatttggcgaaggattcgtacgtcatgtattatcgtatcgtgtttgtgatggctgtcttttttggtgccgtgtttaaaaatgacttcgtctggggtgtggcagatatgctaaatggactgatggcgattccaaacttaatcgggctcatcggtttatcaggggttgttgtatttgaatccaaacgaatcattgttaagattaagcaggagaaaaaggagaaaaacatctctgtgtcatcttaatagcccttttattcttttgcatttctgttaaaatagacatattattcgacacatatgcaggaaaggacgtgccgcccttgtcagagcaaaaagcggctgaagtcaatcagctgattgaagacatttcgcaaaagttaaatatgctgaacattggagtcatcaaagcagaggacttcagtccagacaagtacgaagatattgaatttcttcaccaaatggtgatgaaaaaatcttcattcagcccaagtgaaatgcaagccatcgcaagcgagctaaaaaacttaagaaaataatggtgaaaaaggaaactgtttttatggtctacacgctgttttcttacatcatgcacacaaaaagccagcaccccgcaaggtgctggctttacaactgcggttttatttctcaagcagttttaatgattcacggttaaaggctggaatgtcatcaggtgtacggcttgtcacaagctgatcctgacaaacgacgacttcttcgtctttaaatttagcgcctgcgttttccatatcgactttgatggatgtatagccagtcgcgcctcttccttcaagcgtcttcgctgtaatgagcaattgcggtccgtgacagattgcaaatactggttttttctcatccataaatgctttagtgaattggacgtaacgatcatctgcacgtagaatatctggtgagaaaccgccaggaatgagaagtgcatcgaagtcttcaggcttcacgttgtcaatagacgcatccactcttacttctgcctctccttgcttccctttcactgtttttcctttttcattttcaatgactgtcaactcatgacctgcatctttaaaggcttttgcaggctcggtgaattcaacatcctcaaagtaatctgttaatacaactgcaattttcttacccatgtagaaaccctcctgcttgattatcgtttacactacacactatacccgggcatgttgaaatcaaacatcctatccctatcagaaaaccccttatgataaaaatgaacatttagactcattcacattcccttaacaaggtaattcgtatgatttgtgttatctttacaataatcttcaaaaaataactacaaaagttaacgaaacatttctacaataggtattgtggtcaaaaaaattagaaaggcggagatcaggtgaagaagcaagcacataggtctaaacgaaggaaaaacctgtctattctgctcacttccattatgatgattagtctcattctcccagcagtacctactcatgcagaaacagaaaacggcaaagccgtaaaggtcagtatcttagccacaaccgatgttcatgcgaacatgatgaattatgattattacagcgacaaagagacaaatgaatttggtttggcaaaaacagccgagctcattgacaagcaccgctcacaaaacccaaatacactccttgttgataacggagacctgattcaaggaacccctcttggagaatacgtttacaaaaatgagaaagacagcatcatcaatcaaacaaaggttcaccctattattcatacactcaacaaactaaaatacgatgcaggaacacttggcaatcatgaatttaactacggattatccttccttgacggtaccattgcgggcgccaatttcccgattgttaatgcgaacgtcaaaaagctaaatggagaacaccgttttacaccttatgtgatccaagataaaacctttaaagatgcaagcggagcctcacaaactgtgaaagttggttacataggattcgttccaccacaaattatgacgtgggataagaagcatttagatggacaagtccaagtgcaggacatcgtcgaatctgccaatgaaaccattcctgaaatgaaagagaaaggcgcagatgtcattgtcgctcttgctcatacaggaattgaaaaaaacgcttcacctaaaggatcagaaaatatgatctttgaccttgctacgaaaacaaaaggcatcgatgccattgtatcaggccaccagcatggcacattcccaagcgctgaatataacggcgtcgacaaattcaatgtctcaaaaggaaccatcaacggcatcccagtcgtcatgtcaaaaaactggggcagctacctcggagtcattgatttaacactagagcctgatggaggcaactggaaggtcacagacggaacaggcaagatcgaatctgttgccggagtatcatctcaaaacagcaccgtaaaagatgccattcaaacaacgcatcaaaacacacttgattacgtgagaaagcctgttggcaaaacagaagcagacattaacagctttttcgctcaagtgatggatgacccttcaatacaaattgtgacagatgcccaaaaatggtatgcacaagaaaaaatgaaggacacgtcatacaaaaacttaccgattttatctgcaggcgctccgtttaaagccggcggccgaaacggtgtgaattattatacgaatatcgcaaaaggagatttagcgattaagaacatcggcgatctctacctttacgataacactgtgcagattgtgaaactgaaaggcagtgaagtgaaagactggttagaaatgtctgccggccagtttaatcagatcaaaccgaacgatgcaaaggaacagccgattttaaacgaggaataccgctcgtataactttgatgtgattgatggcgtgacataccaagtcgatgtgacgcagcctgctaaatacagcacaacaggcacacttcttaacaccaatgccaaccgcattaaaaacctgtcttacaacgggaaacccgtctctgacaatcaagaatttttagtcgtaacaaataactatcgtgcttctggcggcggaggattccctcatttgacgcaagataaagtagtgcttgcctcagcagatgagaaccgccaagtactgatggattatattatcgaacaaaaaacgatcaacccaagtgcagatcaaaactggtcgattgcaccgatcaaaggcgcaaccgtcacttttgaatcttctcttttagccaaaccgtttgctgagaaatcaagcagcgtagactttattcgtaacgcaagcacagatggtcttggtgtatacaagctagcctttaaagacgatggcacaacagaaccgccttcatcagataactggaatttaacagtgatgcatacgaacgatacacacgcacaccttgatgatgcggcaagacgcgcaacaaagatcaaagaaatccgtgctgaaaataagaacaatattctattagacgctggagatgtcttctctggtgacctgtacttcacaaagtggcaaggacttgccgatctaaaattgatgaacttaatgaaatacgatgccatgacgtttggtaatcatgaatttgacaaaggtccttctgtactccgtcaattcctgacaggtgatgcatcagatgtcgatccgaaaaaccgtcatcaatttgaaaagcctcgattcccggtcgtgtcatcaaacgtggatgtctcgaaggaaaaacaattgagtgacttaatgaaaaaaccagcctcatttaaagctggtgagaaaaaagaagccggaatttacccttacatcctgctcgatgtaaacggtgaaaaggtcgccgtattcggtttaacgactgaagacacagccattacatctagcagcggtcctaacattcaatttaaagatgcgtacaagaaagcaaaagaaacagtcaacaccattcaaacaaaagaaaaaattaataaaatcattgcgttaacacacattggctacaaccgtgatcttgagctcgctcaaaaagtagacggaattgatttaatcattggcggtcacacacacacccttgtcgaaaaattaaaggttatcaagaaaaaagaacctacgatcgtcgctcaagtcaaagattacggacaatttttaggaaaagtagacgtggcctttgacaaaaaaggtgtcgtccagccaaaagaatcttcttttgacctaatcccaattgatgactctgtcaaagaagatgcagaggcaaaagcgatccttgatggatacaaagcagaaattcaagatttaaaaacagaaaaagtcggccatacagatgtccttttagatggccagcgtgagcatgtccgtgcgaaggaaacgaatcttgggaactttattgctgacggcatgctgcagaaagcgcaagaatctgctggagctgaccttgccatcacaaacggcggcggtattcgtggaagcatcgaaaaaggtgatatcactttaggtgatattttaacggtgatgcctttcggaaataccctttatgtcgcagatttaaaaggcagtcaaattaaaaaagcactcgaacagggcctgtcaggcattgaggaaggcggaggcgcattccctcatgtagctggcattgaatatacgtttacactcagtaaaccagctggcagcagactgattgatgtgaaactgaaagaccaaaagggtcaactgacagacattgatgatgagaaaacataccgcgtagctacaaacgcatttgtcggcacaggcggcgacggctacagcgtctttacagaagcctctcatggtgaagatttagggtatgtcgactatgaaatcttcaaagagcaaatcgagaaggcagatgggaagatttcgcctgtcatcgatcacagggtgaaagaagtgttccttcctcgcgtgaaaggaaaaggcgcttatgacattcaagatgatgagaaattccaaacgtatgtgcagcatacaaacaaagcattgctatatttagacaaagcaagcaaagcgaaaaacgttcaattgtctctatcaaaagcacaagtagccgagctgaagaaaagagagcaagatccaaacgtcaccatctatcatgacaaagtgggactcgcattacctctctcaaatttgtccgagaaaaacgcagatatatggatgacaaaaacggataaagtgaaaaacgcattaacggatacgtatgatttccaaatcaaacaagacaagaaaaaggtttcgacctttaaagacccggtcacactatcctttacactagacgagccgcaaaaagcgaaaaaacctagtgtgtattatgtggatcgcaagaaaaatcgttacaccaaaacaagtaatggatcatttgaaaacggagtcgtatcaggtcaaactgagcacttcagcgaatataccgtcctcaaccaaagcgaggcagctggaacaaccccagatcaaactggcggagacggcggaacaacagcaccaggcggaggcacagatccaaaccaagatggaaccggcctcccaggcggcacactgccgaatacagccacaatgatgtatacagctgtattgattggtgtactcatgcttgcctcaggaggtatcctatattactaccagcgcaagcgtacaagaaaaaatgtttcatcctaaaagaaaaggacagagccgcctatgctctgtccttttttcatctcaatcttgggataaataaatccaattgcgcttatcaaattctttcacatcatctgaccctatatgacgcagcattctattaaagaacgtgatgtcatcttcatcatcgacggcatataaatcctcttgaacataatctcttatcataacattcgttaagttcgtatgattcacaaagtctgcaaaataatcttctacaagagttaaatcctcttcacttaatttttcatcattgataatggaaatatgaaaaacattcaaatacgcttgtatatcttcttcatccatataacataaaggttccagctttctgtcttctgccgtaaacggttttcgcgtatcttcaatgatgacataacataaaatctgctgatctttcatcacgctgaatatttctaaatctcttaattttaatgatctatttaatctcatcatctttcctcctgaaagtagtgatctattcgtcatctacttttcccaaaacccgaaaaggacagagcctatgctctgtccaatttttctcttctagcaaaatcgacgaatctgaagcggtctaatcggtgacggctttcagtgtattgaaataaacttgtatcctctaagaacacgtaattcttcacgacgacgacatggtcaaacccgttcaaatcaagatacttggcgtcctcttctgtacatggctctaccacaaactccttttgggcatagctgattgatacaccgagctctccttcaatatactcgtagatggatccttcgcatatgtctttcgacaagactgacacatgcttttgcaaaaagtaatccttgtctaaaatcacttcttctccgctaatattacgagatcgaatgacttcccagacatcctcctgcccactaattttcagctgagactgaatatactgatccggtttgattaaaccaaattcgtgaaccgtcgtaacggtctttcggccaagcgtttgggaaagttctttaaagctgacaagacctgagactgggaattgcattttctctcgattcagcaagacagagcctttgccgcggattttttggatatagccattttgcacaaggatatttaatgcctttcttaccgtctcacgggatgtgtcatacatcaaggacagctcatgctctgatggcagaatgcctttatcctgccattcaccttgttcaattcgttttgcgagctgatcataaatcactcgaaacttattctctttcattttccctccgccccattttctagcgtttggttaaatgataaacgattgactcatatggacgcaacgtaaatcccttcatatctgccggcacatcctcataattggataacagcacttgcccttccatctcatctacagcctgcacaagctcatcaggaagcgtaaaatccgtctctcctgcgtaaaagtgattgatcacaagaagcttctcctcaccgctttctctcacataagcaaaaaccttcgggtcatctgctaagagtaaggtgaagcttccatatgtgatcacgtcaagttctttacgcatcttgcaaagggcttgatagtggtagaaaatagacgtcttgtcttttaatgaagcttcgaccgaaatgtcgttattggctggctcaatccatggtgttccttttgagaaaccagcgttcttttctgaggtccactgcatcggtgttctcgcattatctcttgatttgacctgtaaaatggcgagcgcttcttcctttgatttccctttttcaagcatggcttcatacatattgagtgattcaatatcgcggtaagacgagatgtcctcaaactgaggattcttcatgccaatctcttccccttgataaatatatggcgtcccttgcatgagatgaatggtggtcgccagcatcttcgctgattgctgatggtacgtttcatcatcaccgtatcttgagacgatacgcggctgatcatgattgcaccagaagagcgcattccagccgccgccctcatgcattttcgtctgccactcacatagaatcgacttcaattcctgaaaatcaaatggtgcgagtgcccatttttctccgtttggataatcgacctttaaatgatggaaattaaacgtcatatccagctcctgccgatccggtcttgtataccgaatacagtctgcgatattcgttgaagacatttctccaactgtcatgctgtcatatttcgaaaaaacctcttggttcatttcgtgcagaaactcatgaatgcttgggccatccgtataatacattcggccgtctccttgtacagattgtccggcgtcatctaagaagcgttgatcctttgagatgttgttgatgacatccagcctgaatccatcaattcctttttcaaaccaaaaatgcatgatgtcgtatacttgcctgcgaacctcatccttctcccaattaagatccgcttgggtgacatcgtataaatgaagataatactctcctgtttcttcatctagctcccatgctggaccgccaaattttgactgccaatcatttggcggagatccgtccactttaggctccttccaaatataataatctcgataaggattatcctttgactcgcgagatgcttgaaaccactcatggaaaatggatgtatgattgacggctaaatccatgatgactcgtatgcctcgatcatgggcttctttcagcatgtgttcaaaatctgccattgtgccgtacatgtcatggatttttgtataatcactaatatcatagccgttgtcatgctgcggggactcatacattggcgtgagccaaatacaatccgccccaagctgtttgatataatcgagcttttttgtcaccccattgatatcgcctgtacctgagcccgttgtatctaaaaagctcttcggataaatttggtaaaccaccgcttttttccaccacggttcgtttgtttgttgtttcaatttcatccaccaccactagttaagttcttgtgaaacatctttcttcttttttagctttgcatacaaaagggttccgatgaatgggacgatgagaacaatgaccatccctatcgcaaatgcgccccaatatttcgggataatagagaagattcctggaatgcctccaacaccaactgagcttgccagcaccccttgagaggcgataaacataccagctaaaccagagctaatgagtgcgaaaataaatgggaatcggtagcgcaagttgacgccaaacatcgctggctcggtaattcctaagtaagcggaaatacttgatgtgagcgagagacccttttgcttttcatctttcaatacaaacatcatcgcaagtgcggctgatccttgtgcaatattagacagtgcgagcatcggccatagaaacgtgccatgcagttttgaattaattaattgaatatcaacagcgaggaacgtatgatgcattcctgtaatgactaacgccgcatacaaaccgccatataatagaccgcctagtgctgcgaactgctggaatacagcgacaagtccagatgttaacacgttaccgattgcaaatgtaataggtccgatgacgataaaggataaaaagccaatgactaataacgtaatcggtgcaaccactaatagctggatgctttcaggtgtccgttttgtgataaacaattcgagcttcgctaataaatacgaggcaacgagtatcggaaggacctgtccttgatatcctaccttttgcacttcgagtccaaacaaattccagacaggaatctcaccggacttttcagccgctccatagccccacgcatttaataaatctgggtgtacgagcatgagtccaaggaccatccctaaaagcggatttcccccaaaccgcttcacggctgaccagccgattaatgcgggcaggaatgtgaaggcagtgcctgcaatcaagttgatcatattcgctaaatctgcccatgccggatacacatctacaatcgatttttgatcaaagaaaatatcaggagctgttaaaatattattaatccccattaataaaccggcggtgacgatggcaggaagaatcggaataaaaatatccgcaagcgttttcacagcacgctgcaatggatttaatttttgatcagaggcacgcttcacgtcctcttttgtggcttccccaatccctgtctgtttcaccatttcggcatatacccgattgacgaccccttggccgatcaccacttggtattgaccgttcgctgagaaagatcccttcacttcttctatttgttcaagtgctttctcatcaacctttccttcatccttcagaacaaagcgcagccttgtcacacaatgtgtcgcttgatcaatattttctttgccgccgatggctttcacaatctgatctgctgctgcctggtaatcagccatgctatcccctccgagatcgttttttataagaaaaaagaaccaaaaaacttgtatatacatgtttgattcttattttatatttgtatatacatgtagtcaacaacaaaatgtagcgctttcatataaaaagccccctcaatgtgctcaggagaggcttcgtgtcatcatctttttttatgctccgttaatttttcgtagaccctgtttttataaaaggaggaggctggacgggcaaaagtttggcgcttagatgtgagttcatccagtcgtttttgtttttcttcacatatgagagaaagcttttttctttcctctccgtctatactggagtgaagcagctctttgacggtcatgagttcttttttcaatgctgtttcttccccagcaaagccagcatttttcatcatccggtagcccattcttagttcttcaggcacatgagcagcgtcatctttaggcagaggtttgccaaagccagataaaccatcaaaagccccgttatccatcgcttttttaatccgttcttctgataatctctgtgcaaaatccatggcgttctcctttcgtctgaaacgatttgattaagcatagcaaaaaagctgactctctcacaagagtcagcttcagctacactgaacataaaacaaagggctaaaatcaaaatcattttagccctttctcgttatttattgtcgattttgaaagtagaaaccatctgtgctaagtcctctgacatatcagatagctgttcaatcgcacttgaaatttgctgcattccagcactttgctgttctgttgctgccgctacttcttgagagctagctgcatgttcttccgatacaacagaaatttgctcaatcgatgtagaaatcgtttgatatgcttgctcaacttgcttaatagaagcaagcaaattgttcgttcttcttgaaaactgagacacaccgtcgtaaatcaatgcgaagttttgtgacgtgccttccatttgctcacgtccttcttccactgctttactgctttcctctacgctttcaagaacgcgctgactgttttcctgtgtaccaatgacgaggtctgaaacggttttagccgcatccgctgattgctcagctaacttgcgcacctcatctgccacaacagcaaacccttttccttcttctccaacacgtgccgcttcaattgaagcattcagtgcaagcagattcgtttgggctgaaatgtccgtaataatcgagatgacactttcaatctccgttgaatgagattgtaattcttctgctgcctgctttgagttggtcatcttatcatgtagcatattcagatgatcaagcacatggttgactaatttttgaccagattctgattgctcttgtacgtcagatgaaacagatttcatttcatcaacttctttggtgacgccttcgatttgagtatcgatctcagcaacggatgtcgtacaatccgtaatatttgcaacagaatcattgattccttcactcatattcgtcatagcttctgatacttgctgcgcactttgactcgattcggtcgtcactgtacgaagctgtgaagacattttcgacacttcactagatgagtttgagattttcgaaatgagctctttaatccgtccctgcatcttttggaaggatgcggcaagctggccgatctcgtctttactttcaacctctaccataccagttaaatcaccgtcagcaattcggttcgctgattccatcaatgaacgtgctggtttcgcaattcttcttcccataaagaatgagaagagtaaaccaccgatgagcacaatggcagatgccactgtaatatagatcgtcagcttcttcgttgtttcaggcacgacagatgcatctaaatcaatccctaaaatccctgtcagctcaccgcctgaatcctttattggcaaaaagactgatttatgtgttccaaatgagtctttgtaaatatcacttttgaccattttatcttcagagagcgcttgtttcatctcatctgaaaagacataatcttgatcaaaatcattttcttctccggttaagataattattctttctttgccgcctttattagaaagcacatataagttctcaagcgtatgatcttcttgaagctctgtgaatttctttttgacctccacatataggggatcatctttcccgctaacaccaaggacgtttccatccacattatcaatctctttcttcgctgtatcaatatctgttgttaatcgataatcaaattgctttaataactgggatgataaatcctgacttactagataaaatgttagaacgaatagtgcaacggttgctagtaatgttacgacaacgactgacatgattttagaggatatcgtgtatcctccaaatttcctttgtttcgccattttttcctacatctccactctcagatttgatttaagcatgtacatgttcaaattgtccacaaacagatgcgatcacatcttttaaataagatacgatatgtgggatatgctctggtaacgtataaggtgagatgacaaaaaacttactaacacttagatagaattcttgtccttcttttgcatttacaagtaaaaacttcgttgtatccccaaagaacatttcgtctcgtttctctccaagcttttcaaacagcattttgttcaattcattgttccgctcaatttccattgccgtcgcttcgcctgaaatttcttcttgaaagcgcggtgagccatctaggtaaattctaaataatgtagccattccgacgttgtcatcattcacgacttctgcttgcggaatttcttgactgagtgcttctctgaaggcaaggttcacctctaagaattgaccaagcaagcgctggtagccttcaatcccaaacgttaacagcacactcagcatactaattgagcttcccattcttgagcattccagtgtataacccgtatggtattcgccgtagcctctatgaccaacgtatggtgtctcttgttcttccagatctaaacgctttaggtctgctgcgtttttcactaagaataaactagatgtgtaaggcgtttggccgagcttttgaaagtcaaagcacatcgtgtcagcaagagaaagatgctggaatttcgctttgatttcttttagcatacgaagaacaccgtctgtgaattgcagcgggttttcagctagatcatactcattaaagaaagcaaagaatccgccgagcgctgaatctgcatgaatatgcggcacctttagaccatactcctcagcaatggcttctgctgtttcacgtaccccttttacatcatcaattgcaatggcatctgttgttccggttgttgcgacaatataaacgggaattccgccattttgtgcaacacgttccatttgacaacgcaaatcttccatatccatcgaatgatctttattcgtcttaattctgatcaagttgtctgtgcctagtcctgttgcttccattgacttaaataagctgtaatgtgccgcatcagaacaaaacgcataaaggttttgcggaactccttttcgtagtgactccggcgcaacttttgcaatcgctaaacgcagtcctgagaaaatggctccttgacctccccatgttgtatatcccccgctcacacttggatcatatccgatgagcttagacatcattgagaccactctgacctcagcttccgctcctgctggtccatacacatcccataggttgtttccatttaccagcatcgccgttagcatgcctagaattcctggtgtacttgccatcggcaaaatgttcgtgaagaaatactttgtgtggtaaggatggttatgtaaaagcttcagtaattcttcattcacaagttccgcttgttggccgttcaccggaatttgacttgtttcagtgagcttttgataaaaatcctcctcgcgattcttttcaccctttaggtgtgcacggttcggatctttcaggtgatcgacccctgaaactatctgctccatcaatttgatgagttctttacgctctgctgcatttccgtcctcactcggaaaccagttctgaacgaggttgtttgctcgtacagtcatatactatcaatcctttcaatggaagatttcctgtcaaagtctatatcgaccccatttcaaaagtttatagtctcgaaatgttcacttaagtatatttagataatttgttcattcatcaaaataaataaaacccttacaaaacacatcaaaaccattatgtcgatgaaacaaaaaaatatattgatatatctcatagcaggaaatttcatccacacctttcctccgtttttcttctcattttttttacttaacctgcataaacattacgaaacactggaaatactctctaaatcatcattgtagaaactaaattaattctttagactcgtgcctttttacctgttttattgatatagcaactgggaaattgctgaattttctgttaataataggatgaatttcataaaaagtttttcgaagatcgaatattttcgttctctccccttttatggcgcggacgagctgctagacactcttcgccggttatcacttttctatttgatcatttcatggtatattctaatggttcgttttctttcgttccgcctcttccgtgtatcggagaaaaggagtgtttttatgaaaacatttattcaaaaacgaggcctcggcttctttgttattgcagccatcttactttggctcaaaacgtattcagcctatttaattgaatttaaacttggtatatcaaatgtgcttcagcatattttgcttttcgtgaatcctattagctccagcttgttctttcttggctttgctttattgttcaagaaaaaatggcagcctgccgctatcattgtgattcattttttcatgtcttttttactatacgcaaacatcgtgtactatcgattcttcaatgactttatcacgctgcctaccgtgatgcaggcaggaacgaatggcggacaattaggtgatagtgcattttcactcatgcgttggactgatatgttttactttatggataccatcattttgatcgtactcgcagtccgcatgaaaaagcagcaaacaagtacagctactgtacctgttcaaaagtcaaaatcgtttagactcgtccttgtgtcctctgttgtcatctttgtgatgaatttagtcgctgcagagattgatcgtccagagcttttatcaagatcgtttgaccgcaattatttagtgaaatatttaggtgcttataactttactgtgtttgatgccattcaaaatgtgaaatcaaacagccagcgtgctctggcaaattcaagtgacgtgacagatgtagagaactatttaaaagcgaacagcgctgatcctaacccggcttattacgggaaagcgaaaggcatgaacgtgattacgatttctcttgaatctctgcaaaactttgtcattgattacaaagtaaacggaaaagaagtgacgcctttccttaattcaatggcacacgacaacaaaacgttttactttgataacttcttccatcaaacaggacaaggaaagacgtctgatgctgaatttatgatggatactgggttattcccattatcacaaggctctgtttttattaacaaagcgcaaaacacgtatcaagccattcctggcatcctgaagaaggatcagtacacgtcagcagaattccacggcaatacgaaaaccttctggaaccgtaatgaaatgtttaagtcatttggatatgacagattttacgattctgagtactacgatatgaatgagcaagatacgaagaactatgggctgaaagacaaaccattcttcaaagaatctatgccaatgcttgaaaacttaaagcagccgttttattcgaaattcattacgttatcgaaccatttcccatttggaatggatgaaggggataccgatttcgaacctggcgacttcggagactctgtcgtcgacaactatttccaatcggctcattatttagatgaagccatcgaacagttcttcaacgacctgaaaaaatctggtctctatgacaatacagtcgtcattatgtacggagaccattacggcatttctgaaaaccacaatgaagcgatggaaaaagtgacaggacaaaaaatcggggattatgaaaatgcgcagctcatgcgtgtaccgctatttattcatgtaccaggagtaaaaggcggacagattcataaatactctggtgaagtcgatgtcgcaccaacccttctgcacctgcttggcgatgatacgaagaactatttaatgtctggttctgatatcttatcgaaaaatttcaaggagctagtgccatttagaaatggtgacttcgtctctaaggattacacaaaagtaggcaataactattacagcaacaaaacaggcgagaaaatcgagccgactgataaggcatcacaagaaaatgaaacggtgaaaaagatgcttgagacatctgataagattgtcaccgaagatttactccgtttctacaagcctaaaggctttacaccgattgaccgcaatcaatatgactatacaaagaaagtacaggatgaagaagattcctcttccgccaaagatgaatccagctcttcatcaaaataactttctcattttaagaaccagccgatccctgatcagctggttcttttcacgtttgactgctattgcactgggtatagaaagaagaaggagggattttatcatgaagaaaacaaccgcttttgttatgactgcttcactcgctacgtccgccctcattggattcagtcctgcagtctcagcacacgctatgaccaaaacagcagtcgaacaatccgttcctcaaggtccgaataccgctttaaacaacatttatgaactggcacataaaggacaaatgccgtattatgcaaaaggtcttaaaattggtgttcaaacaaagaaggctgtccatcataaactaggaaatccatatccagaaacaggtcaaagcagctttgatttgtatcatgctgaaatggggaatccgggatttgcttttcattatgatgcaaaaggcaaaattgacgaaatccgttatttcggaacaaatgtagaaaaagaaacgaatatcggcggaatgaccccttccctattaaagaaacaacttggacaagcggattcggtcagcaccatcccacagacaaaagagaaaaaatacgtatatcgtactggagattatgagctggaatttatcgtcggccatgacccagatataaatcagcagaagctcaccgtcctgcatattaacctagtgaaagctgatgcctaaataaaaaaagcatcctgagcagaagctgaggatgctttttctttattatgaagccacttctaaatgcggctttcttttcatttttcgtttcaagactggacctgcgacataatcaagtccaaatttgccagcatttcctttcgcagccatgatgacgatagcaatgactagaagaagcgggttgacagagacggtaccagctagtaagaaagagacattcatcatgcttccgaaaaaggctgccgttgttgtgaataatccaacaattaatcctagacctactaaaatttctccccacatgaccatggtactgaatagtccagcattcggcaaagcgacattttctaaaaaccatacatagaacggatacacgagatgtccatctttgacaacaggttcagctatcgcaaattgtaaatatcctgatgcatcgaatccgcctgttagttttcctataccagatgtgagccaagtccaaccgatataaagtcttgctgccaaaaggataaccgctgcccatacattcgtttgtaagaattttgtaaacatgatgatgccccctttaatttatgtgaatttcttcacattttatttatgatcttattatactacgttaaaactaatttgtgatctttttcacatacatattcacaaattgttcatgaatatctagttgaggtaacttttcccttgctaaatccgtcttagtcatttcagacaaagaaaagaggtttcattttgtatgaaaacattattccattttgcttacttacaggcggtgtcgtgtctattccccgtcatgatctttgcggcgcttgctctatcaaagatggtgacgattccttatctacaccggtatgatttcattctattgctttgccttcttgcccaaattctcatgctgacgcttcggctggagacattgaatgaattgaaggtgatctgtctatttcacctgataggtattggcttagaaatgtataaagttcatatgggttcttggtcctatcctgaagaagcatatacgaaggtctttggggttccgctctatagcggatttatgtatgcaagtgtagcaagctatatttatcaggcactgtcccggcttcgcgtgcaggttagctcatggcctcatccgtttctttcgatcgggatcagtttgtgtatttatctcaatttttttacgcatcattggttctatgacctgagatggtggctgacattactgcttgttgtcgtatttcgaaaaacgtccgtctcatttcaggttggttcttctacctttcgaatgccgcttgtcgtctcattcttgctgattggtttctttatttggattgccgaaaatgtcaccacctttttaggggcatggcaatatccaaatcaacagcacgcttggtctctcgtccatcttggaaaaatcagttcttggtttttacttgttgtcatcagtattgtgctcgtcatcgaacagcgcaaacaaaaaaacgttcagcccatttaacctggctgaacgctttttttaatcccgatcgacttccttgcgaagatcatctgcgacaaattctacattcgttccgatgatgatttgtacggagttttttcctgaagtcagtacccctttggcacctgcttttttcaaagtactttcatttaataattgtgtatcttctactgttaaacgcaggcgggtcgcacaatgatcaatcgtagtgatattgtctttgcctccaagtccctctagaagaatacttgccccttctgtcttcgtatcatcggctgcaatatcttcaatctcatcatcttccctgcccggtgttttaagctttaacagtttaatgaggaaatagaaaacaacaaagtacaaaatgccataaagcaccccaacgccaagcagcatgagtggtttttgtgcaatgccaaagcttaaaacataatcaatcgctcctgctgaaaaagcgaagccgctatgaatcccgagaatgttcacaataaagagcgagagacccgttagtacagcatggacaccatataagagtggagataaaaacataaatgaaaattcaattggttcagtgatccctgtaataaatgacgtcagcgccatcccaatcatcaaaccagccgttgcttttcgcttttcaggctttgcggtcacaatcatggctagacatgctgctggcagaccgaacatcatcactgggaagaaaccagtcataaagacacccgcgcttggatctcctttaaagaatctcgctagatctcctgttgccccgctgaattccccgaattgaaaccaaaataagttattcagcacatgatgaagccctaatggaatgagcaaacggttaaagaaaccaaacagccctgcacccgttgcaccaagacttaaaatccattctcctaaaccattgatcccgctttgaatcggaggccatacaaatccgaaaacggctgctaataaaatggtgaaaagtgcggtcataatcggcacaagccgtcttccgctaaagaaacctaagtattctggcagcttcgtatccttgaagcgattgtacacataacctgccaatagcccgcataaaataccgcccaatacccccatattgttcgttgaattaatcgacgttgtaccagctgataaaataaaataagagatcgcacctgataatgccgctgccccgttaccatcctttgcgatgccgatcgctatccccattgcaaaaattaaagccaagtttgcaaaaatggcatttccagccgcatgaataaacgggatatcgaatacatcctcccgcccaatagccaaaataatccctgctgctggaagtacagcgattggaagcataaaagatttgcctagcttttgaaaaaactgaaacaccatctgccttctccccctttgtcatcatcatgacctaatcgtttcgtccatgatgctcataaaaaatatatcatatacacatctagttatctataccaatttgtccacattcgtttgaattccgctctttactctttttgcgtaaaatgtggtaagctattgaatagaatgaagttatagaaagcgggaatgaacagtgattgtcaaacatgatcatgagttagaagccttaaaaaaagtcggccgaattgtcgctttggcaagagaagaaatgaaaagccaagcgaaaccaggcatgtctacaaaggaactagatttgattgggaaaaaaatattagaggaacatggagccaattcagcacctgaaaaggaatatgacttccctgggacgacttgtatcagcgtgaacgatgaagttgctcacggtattccaagtgaaaaaaccattttacaagagggtgacctcattaatattgatatctcagcagagctggacggctattattccgataccggtatttcattcgtattaggtacaggtgatgctcgccttgaggcattatgccagtgtgcagaggatgcattcctcgaaggattaaagcatgcaaaagccggtaagagacaaaaccaaattggccgtgcagtctacaatacagcaaaagaacaaggatttactgtcattaaaaatctgacaggacatggcattgggaaaagtctacacgaggcacctaaccatatattgaattattatgatccattcgataatgctttgtttaagaatggcaccgtgatcgcctttgaaccttttatttcaacaaatgctgaatcgatttatcaggctgatgacggctggacatttaaaacaccagataaaagcctagtcgcacagattgaacataccattgtgatcacaaaagacgaaccaattatattaacgaagctgtaagccagctgatccccttcttcattggaggggattttttcgtttccctttcacgaatctgtcacgactaaacaaaaatgcctgtggtaaaataggcaaagatatgcgaaaggggtcttatttgatatgtggttcatcatcatcggcgttatctttttgattgaaagtattatcttaacggttgtaggtattaagaaaaaacaatccatgatgacttaccttggtattgtcatcatgattatgacggtcggcatgatcatcgttaccctcaacccgccaaattcataaatgtttatttccagcatatacatggttcataggaagatagaatcagttttcatttattcatacctgcacacttttcacgtccctttttgagatgttacaatgcaggcagtttcaattgaaaggagttttctatcatgcattatggtagcaaaggctggtatgtcgaagaattaaagaagcttggtgtgaccaagcatgaaggaagaaagcttcaaagcttaaaaacatatttccttgcaaatcttcttgagcaaaagaaacctagctcataagcgcttaaaagccgtacatcttaagctgatgttcggctttttttaaatggactgaattcgtttttctaaagacttcctcaccacatctgctaaagcatctacttcaagaacggctttcagcctctctggacttgtttgacgatatttgacctcgttcacttcatggattgtaatgtgatgagacgctttttctactaatacaagagaagcatcagcaggcactaagccttccttcagcacccgtaaataaaaaccggtataccctgtttgctgcacttcctttacaagcttcatgttgccatgcttaaaagatagtttcacacacggctgtctaggctgactcacttcaacaagtgcttctccaagctgaaatacatcgccaatccgcacttttgtttccactagttggtgcacggtcacattctcaccgaaggcagcttcctgtaacggaacccctaagaactgctcaaaataagcataatgatcgtatggaaagacgcagacggctttatcatatcctccatgatgaaccaaatcaccttgaccatctccctcaaaattgaccttattcaaatagacaggctcatgtattcgctttttgttgatcgcggttttgatttcttttccgtttgcataggtcgtgatgggctgtcctacttggattccagctatgtcgtatttcttctgtcccacgatgaccatctcctttgattgtctcatggctattattttacatcgttagacaatgaaatcatagtcgatgcgtgaagatcaattacatgctatggtacgatgagaaaaaaggagagatgacattgattcattatcatgccattgtcacaggacgggtgcagggagtcggctttcgctattttgtacaaggagaagccgtcaatcgcgggatgaaaggctgggtacgcaacacagataacgagcaagtcgagttaaaggtagagggtgagcagcaggaagtgcttgatttcttaaagactgtccggaaaggaagccctttttcaaaggtcacagatatgcagatggagccgctcactgaattagcttattatcaggattttcgcatcaagggatgaagttttcataaaaaaagcctagctttcgctaggctttttctgttccatgatagggcttttcctgataaaaataattcggcttcacaatggtattgtcgtagtgcttgtggaagatgtgggtagcagctggtgagaccggtggaatcagccaagtccagtccccagtcagcttacggtcagccttttcttcctgcttttcgaactgcttgaattgatgtgctgctgtatggtgatcaacaatggtcacccctgcttccctgtaagaatgaagaaccgccacattcaactccacaatggctttgtccttccaaagcgacgcattctttgtcgtgtccagtcctaaaatcgaagcgacttttttcagcatattgtagcgattttcatcggctaagttacgtgcgccaatctctgtgcccatataccagccattaaacggcgctgcattataatgaataccgccaatctccaatttcatatcagcaataatcggaacggcgtaccatttcagtcccaaatcacgaaacccttcatattccggatgggtgatctcgacttcttgaacgatttccttcggaagctcatacagaactggcggttgatcctttagctgaaacatgagaggcaggatatcaaaatgcgtgccctcccctttccagccatgggcttcacacaattttgttaattcaagagaagcctcgtcgccgatgatgccgtactctgtctcatagcctgcataacgaacgagctgatgattgtaaatgatgacttccttttgcgaatcattttctggaggaaagatcgtaatggatggtttgattttcccaccatttgtcgcatattcaatatgatgaaaaagtgcctctttcacctcttcttctgtcttcacatgacggcagtcgcgaacatgcagggttgaccaaaataaacggccaatgcagcggttgctgttgcgccatgccattttcgccccgtgcgccaattcctcttgtgtgtgagtatacgtccctttagagtcaatttcttgttttatttcatgcagccgtgctgctttctcttcatttgacttacccaattcttcatagcatacagaaataaaagcttctgcttcattccacaacgctccttgattactcaaacatactcgcctcacttcaatacgaatatatccattgtagcggtttctatttataaattcactagtttcaaaccattttttatcatatcatccgaccattgtccttagagcgtggatgaattaatccgtttaagggtttgctcgagccagcggacatagcctttttccctttcaattgcccttgtcagcactaaataatgcccaaattgcgctgaatgaagcgattcagcaccaggatcatcctctattaacgcgtgcagcttctgctttagcatgtccactttcttcgtgcgctctagcagttgatgtgtaagcaggtcggccgcttcttttttgtccatggaggagatgaaaaatgttttgagcatgaattcatcttttgttgtttctgggatcgggtcttttgtccttaaccactgatgcaatgctgcttgccctgcctctgtgatttgatagaacttcttctccagcttctttccttgtatacgaacatcaaattcaataaacccttcttctgtgagccgtttcagctcagggtaaatttggctatgtttcgcactccaaaactgtccaagggaatccttaaaatgcttagtgatatcgtatccagtcagctcacactgatctagtaagccaagaatggcatatttcaaaactctcatgatgtgcctccaacgcttattctttgacattagtataccatagactttaaaataaacatgtaaatcacgacatgtttgaaacaacatcattctaatgaaagaaggaataaacatggatcaattcgttggacttcatatgatttatacgtatgaaaatggctgggaatatgagatttacattaaaaacgatcacaccattgattaccgcattcatagcggaatggttggaggccgctgggtccgtgatcaagaagtgaacattgtgaaattgacaaaaggcgtttacaaagtttcttggacagaaccaactgggacagacgtctctctgaactttatgcctgaagaaaaacgcatgcatggcgtcatcttcttcccaaaatgggtgcatgaacgtccagatatcaccgtttgctatcaaaatgactacatcgatctcatgaaagaatctcgtgaaaagtacgaaacatatccgaaatatgttgttccagaatttgcggacattacgtatattcatcatgcaggtgtaaatgacgaaaccattatcgccgaagcaccatatgaaggtttgactgatgaaataagagcaggacgaaaataaaaagcagcacgcactgtgccgcttctagattgtagacaaagggctaaattgatgttgactttagccctttgtcttttttcagcgtgatagaaaatctttgcagtataggacacgttgagagctaaaatcattttagctcttttttatttaatgcctaacgtcctgttagatagcaagaaccggtacactggcagttcatcgcctacttttgaagcaatcaattcagatgacatgtagctgtcttttgattctggctcaagggcaagtgacaacaaattcgtttgcggctgcgccgtgacatatacctttgtcccttttggcagctgacgtttcttttggatgagttctgtttcaagctgaatatctgtttgactcttttcgtctcgttttgttacttgataggcttgtaccggtacttttacactggcaggtaatgtgacactttttaaccctaaggtctgcagcttccgttctaccccttcatgcccaggtaaaacaagataggctgtcggtcgctctctcgacttgacaggaacagcgtcgctcgcactgtgaaagcgtacagggacattgatggtctgtcctttttcaatatctaccatttcaagcgaatcttccaccggcgctttgaaatcatcttgaatgaccacttgatcgtcatcattcgattggagaccttttttcaccagcttcaaacgctccgtcaccatttgctgcttcacctgctttgcatgtttcaccgttgtttcaatgattttttcatgagtggtgacttgtgctgcgacgcggcgggtaaagtcttctcttccaattccaatccctctgctttctacaagaaaggatagtgctggcgagagcgccaaggcatttcggccaattcgtgcatccgttccgccttcatagagatcgatctttccatcctttcctcttgtgcttgtataatataaatcatttgaaaatccttgatttatcagcgtttcacggacgccgctcacgtataattcatttgacgtgagccggatgctttctggaatattcaagttcttccctgataagatcaataaatcgtgatatttgagtgcacccgctgagccgatatcctcaaactgcttttgtcctacatcgtattcatgggcatcaatgaccacttctggtgcatatcgattaaattcttgatgcagggctgttagctctggagattctaatgtcatatgatcacggttcccatccattccgtttgcaagcctgcggtcaaacgcataagaaccatcagggttgattcttgggacaataatgacgttgacatggctgagtatacgctctccttcatcacctgctaatcgttttgcgatgacgagagccgattcaccggaggccggttcatttccgtgtatttgtgcttgaagccagatcgttggcttttttgaaagtggagaaatatgacgatcctttgtaaagtagagggctggaatggaccgtccttcaatggatgttccaatctgtttctgcgaagcataaggacttttgcggacaatgtcacgtaagaattgttgaagctcttcttgtgtggtgaaggcttctccttttttctgaaatgcgggggtatcgaacgtctcggcaggctcagggtatagcttcttcactggggctggctgttcataattctttccataataaggggtatctgcatgagctgaagctgggctcaccatcgacaaacttcctgctatgagacatactgccgcaaaaagaatcgtgccttttcgtttggacatgctatcctctcccttcgttgatttgcattataaagaaaaaaacagtaaaagtgtcagtatttttcaaaaatatatcttttggaggaacaggcatgcctattgtatagggcaaatgaatcgatcctgctcggcaatatgaactaaaaaaagtgcctgctcacgtagcagacactcttttatttaccaaatggagatggccccaatgagtaccgacatgaccgtcatggcaacaactgcaagcacagcccatttcatcccaaacttctgatgctgatccagtgatacaccaacaagtccaacaagtaaatgtgtggatggaacaagtgggcttaacatatgaatcggctggccaataatagaggctctcgcgatttcaattttatcaacaccatatgctgccgctgtttctgataggatcggcaggaccccgtaaaagtatgcatcattcggcataaagaacgtaaatatcccgctcgttaacgccactatgactggaataaagccgccaagctgctcaggaatggcagaaacaatcgatatcgccatttcatcaaccattttcgtgccagttaagatgcctgtaaaaacccctgccgcaaagatcatggaagcaatcgctaagacgttggttgaatgagccgcaatccgctcacgctgctgttcaaggttcggatagttcacgataattgctacacaaaaggcaagaacaaataggaccgttaagctgacttttcctgagacgagaaggagtaccaataacaacgtaagcgttaggttaaaccaccaaagtttcggtcgcttgatgtcatcctgtagtgccgctgccatttcatttgcatgaatcggctgttcgagctcaataacgccaagacgctttctttcagacttcccaagaaagtatgccaccacaatcatgctcaaaacccctgcaccaatgactggaatcatcggaccaaataaaagtgatggatcaacgccaagtgcacttgccgctctaggtgtggctcctccccatggaatcgtattcataatccccatgccgactccggcaatccccgctaaaataattggacggatgccaagcagcgtaaataatggaagcatcgctgttgttgtaatcatgtacgttgttgtcccatcaccatcaagtgcaacaagcatggtcaggacagctgttccaacgacaatttttaaaggatcgcctttgacaatgtttaaaattttcgccaccatcggatcaaataaaccagcatcaatcataatgccaaagtacaaaatcgcaaacatgatcatgaccgctgtcggtgcgacttgctgtacacctttgacaatcatgtcagaaatttcagtaaaatgaaaacctgcaataagagcaaatgcaattggtgttaataccaatgccgttaaaacagacatacgtttcgtcataatcaaaaccataaatacaaccatcataagaaatcctaagattgctaacactttgttcaccccttatgttgtatacgctttcattaaatgttggtatcccatttccaaccctttctgtcatgatatctgacgcctgaattgaagtaaatattatgaattttaattctttttcgggcgataaatgctttttgttcattttgttcaaaccttgattttgatgaattccatgaaaaaaagcggtcttactcgaccgcttgttccccttggataaactgctcatatcgccttaattgatcttccataaagatctttgcctctttgctgttcatataacgacttgtccagcctttttgcttcatttgctttttccaggacttcgtttgtgtcatttgataaagaagctgatcccattctcgaatgtcgtgctgattcatttgctttggccccatcacaccacgccaatgagagaagataagcggaatcccttgctctttccaagtgggaacgtctttgaatccatctaagcgctgattcgttgtggtcgcgacaagcttcagtcttttcttttcataatcatgacgaacctctgtaatcgtcgtggttgccgcatctacttcatggtcaatgagtgcttgaaataaatcatctgcactgtcaaatttcaaaaactgaatgcggtatggatcaattcctgccatttcggcagcccgtgcgaatgagatttgatcatcatttccaaagtctggggcaaacccgatttttaaggaatccggtttcttctttagtgcatgtaataactccttcccatttgagaaaggagagtcaacaggaactgcaacgacctgccactcttcagcaagaatggcgagcggggtgacatcattcatggtcacgttactgctgcccagtaaattacggcttaataataggcttgaatttaaactaatataattggcatctcgctccatcatatatgtccatcctttatcaaccgttccgcctctttgataaagaatattcacaggctgcttcaccagtttttcttgttctagcacggttttcatcacttgggccgtttggtcaaatccgccgtcgggtacacctgataccacaatgtataaagggctgtactccaggaaagaaactcttgctgttttttcattaaaggtgagcgtcgtacaaaggcagaccaagatgataaggagtattccttttttcatttttatgactccacttgttttttagcaggataatattttcgttctggtctgccaatgattccatatgccagctctgcccggcattctcccgttgtcacaagatactctacatatcgtcttgctgttgtacgtgatgcgcccattttttctccgagttcttccgctgtaattccgctaaactcttcctccattaatgttttcactttgtccaaagtcagtgaattaatacctgttggcaagtctcggtcatccttttgttgcgatgcttcctgcatctgaccaaaaaacagatcaatcatcgtttgattgacttcatcttttgaattgattaactctttcttctctttatattcggttaaaacctgagtgaatttttggaccgtcaccggtttgattaaataatgaaccactccataatgaagcgcgtctcttagcagcatcgtttccgttgcagctgtgataatgatcacatccacatcaggatggcgctctcttaaaagcggcaaaaggttcgtgcctagctcatcaggcatatacacatcaagtaaaataagatccacctgttctttttgaagtgcctcccacatatcctttgcactttttgcctttccggcaacttgaaagccttgtaccttttgtatataagattcatgaatcgcagcaattcgaaaatcatcctccgcaatgagtaccttcatcacaacctattccccctttgtgcctttcggtatgtaaacagtgaagatggcaccgccttctttttggttcgcaacttcaatccagcccccaagttcctccagcacttctttgacattggcaagtccatagcctcgcccttctccctttgatgaatgtcctcttgtgaaaagttgtgaaatggctccttcattgacaccatctcctgaatcagacacctctatgataatatcaaatccaatatctgtgatgaacaggcttacgtctcttttctcctgattcaatacggcctcaaacgcattgtctacgagattgccaatgatggtgataaagtgagataaactcatatggactgggagcggctccaatgaactattttcatcaatgtgaaaatgaacttttttctcagatgcctttcctaacttcccaagtaaaatggcttgtatcttcggagagcgaatttgcttcatgagtaaatcatgctggcgattttgaagagtatattcttctttaattaagtcaatggcttcatccacttgctgtaactcaagcaagcccaaaatagcgtacagtttattcgaaaattcgtgtgtttgcgctctaaggtcttctgaatattggcttacctctgtcaatgtattcaggagcttcgtcagctcggtcttctccctgaagctcacaattcctccaaatactcgattgtcctgcaccacttttttgacatttaacacaaaggttttatcattgacgactgattctatgttaggttcaatcgtctctacctttagataggatagaagattggcatttggcaacacttgatcaatatgaagaggcagcgttgaagagacccgcagcatctgttcagctgacgtattcatcattgtaattgcacctttacggtcaaatgcaatgattccctctttaatcgcgtgcagcatcgcttctctttctcgatataatgaggcaatttcatgcggttcaagccctaatatatcttttcgaatactccttgttaaaaaaatggctccaaaaaccccaggcagcaaaacaagaagggcaatataacttaatttgaatagttgatgggctgtcgcttggtcgatatctctttttaaaaattcgacgctgactgtcccaataatttcttcatgactgcctgtttctttcataattggggcactgcctctgacaacggtttcaccatcagaatcacccgttgatatggaggttcctccaaatagcagtgtacttcttccttccgacacactgatggttttccctacatcctcatgatttgtatgaaaaagaacctttcctttttgattggtgataaaaatagcatgcgctcttacttgctccttcatttgctcaagtacagcctgctcttcgttttgggaatctcctgtagccactgatgttttaataggcggcatatatgaaatcgttctagcagtttgcactgccagctgttcagcttggctctgcctttctgatgtctgcaaaaaaccaaaacaaatggtcaataaggcaataacaacaagcaaaagcccaataattaacccaaaaatttttgtttgtaaagtgactttccttttgcccatcctcaccgccacaacccctaatttatgtagattcacccgaatagactctaagaaaatcatatcactttttctcactaagttaagagaaaattcattcaatacaaaaaaggacgactcatgattgagtcatcccaatgtgttcattacgtgattgataaaccagcactcgcatagcctgcaacggtattcactaatgatagacctgtagctgttgcagagaagacaacgagcaatcttgtttctggtgtgactggtacgttcaaaccagtagcaatgccgtttgaaatagcacctatcgttaaaataccggttaacgctggagccaatgtgacgctcgctacttgcgtgaaactgttatctggtgtcggtgaagcaaacagactagctgttacagtaatactcgtgccaactaaagaaagcgcggctgtcgtactaaaatagccagcaaatgacgtaatggttccatctctcggcactgaaaacgccatgtttagtaatgttcctgctgccccggttaaatcaatgattccgcctacaatactgacacctgtcgctgagttaccaaatccgaccaagctagatgttccaacaagaccgcctgcgattgtggttaaaacagctggcgtaccagatgcaaatggaataattgcactcgatcctgtcacacctgttggacctgtggcgccggtggctcctgttcctgttgctcctgttgctcccgtggctcctgtatctccggttgcaccagttgctccggttgctccggttactccggtcgctcctgtatctcctgttgctccggtcgctccggttactcccgtggctcctgtatctcctgttgcaccagttactccggttgctcctgtatctccggttactccggtcgcacctgtatcacccgttactccggttgctcctgtatctcccgttactccggttgctcctgtatctcccgttactccggttgctcctgtatctcccgttactccggttgctcctgtatctcccgttactccggttgctcctgtatctcctgtggcaccggtcgctccggtatctcctgtagctcctgttactccggtcgctccggtatctcccgttactccggtcgctccggtatctcctgtggcaccggtcgctccggtatctcctgtagctcctgttactccggtcgctccggtatctcctgtagctcctgttactccggtcgctccggtatctcctgtagctcctgttactccggtcgctccggtatctcctgttactccggtggcgccggtagctccggtatctcccgtggctccggttactcctgtagcaccagttactccggtcgctccggtatctcctgtaacaccagtcgctccggtatttcctgtggcaccggtatctcctgtgacgccagttgctccggtatctcccgtggcgccggtagctccggtatctccggtatctcccgtggctccggttgctccggtatctcccgtggcgccggttactccggtcgctccggtcgctccggtatctcctgtggcaccggttgctccggtatctcctgtggcaccggttgctccggttcctgttgcaccggtcgctccggtatctcccgtggctcctgttactccggtcgctccggtatctcccgtggctccggttgctccggttcctgttgcaccggtcgctccggtatctcccgtggcgccggttactccggtcgctccggtatctcccgtggcaccggttgctccggttcctgttgcaccggtagcgccggtatctcccgtggcgccggttactccggtcgctccggtatctcccgtggcgccggttgctccggttcctgttgcaccggtagcgccggtatctcccgtggcgccggttactccggtcgctccggtatctcccgtggctccggttcctgttgcaccggtagcgccggtggctccggtttcaccagctgctgctaacaaggtataatctggtgacgaacctggcgtccctaatggcggcgctgaattcaccacatacgtactcccatcgaatgtcacgacttgacctactggataggttggggctaccgctggatcaaatgctacgatgcccgttaagcctacacccgtggctccagtcgctcctggtggacccgctggacccgctggacccactgcacccgccggacctgctgggcctgctggacctcttcttcctctcccgcctggcggaccttgaatcacacaaacacaaggatcttttccgcagcaaggatttttcactgattttcctggcttacctgatcttcctttcttacaactatcacattcccagccatcatccttatacgcatcataccagcttcctttttggtagtggtctgtcgaatgagttggatatgtctttccgcattgtctacatcttctcatggaatcacccccatccatcgtattcatcgttccttggaaaggtgtatgtacatttttatttttattaaaaatattgaaaagacctcgcgctcgatgcacaaggtcttctatttattgaaatttcattgttattttgatatcttttcctaccatactatatttaacatctgctggacgaatcgcctcttttagtttttttaccccatctccttcaaaaaaagtaggcgcactcttgcctccgattaataaaggtgccatataaatgacagcttcattgacaagtgatgcttctaaaaaggaagcactcacattccctcctgcttcaacaagaactgacatgacagaacgttccttcagcatgcgtaacacttcgtgaatatccgtccgccgctctccgcttgtgacataaatttgatgccctttgtctataagctgttcatactttttctgatcatacatatgcgaggtgcaaataatggtttccgccatacgatctgttaaacatttcgcatgaagcggaatccttaatgtggaatctaaaatgacacgaatgggctgggtcatgattgaatctttcacaataagacctgcatcatcttgaataatcgtttcgacaccagttatcacagcatctgcttcttggcgcaattgctgcacttctgttctcgcttctgttccagtgatccatttgctttcttgatcagccgttgcaattttcccatctattgaaatcgctgattttaatatgacataaggaaggtctgattgaatgaaatgaaaaaaaggcacgtttaagcgctctgcctcctgtttacatattccttcttctacttcgattccagcttgtttcaacatggtcattcccttgcctgctacaagcggattcggatcttgcatcgcaatgactactcgtttcacaccacttttgataatcgcttcagtgcaaggacccgttttcccatgatgcgaacaaggttcaagcgttacatacagatgagctcccttcgccttttctcctgccatttgcagcgcatgaatttcagcatgaggttcacccgccttcatgtgagcacccattccaacaatttcaccttgctgtacaatgacggcaccgacaagcgggtttggggaggtttgccctttcattgcttttgcgttggcaatcgccagtttcatatagaacacatcgtctttcatgtgagtctcctttcttctctttcaagggaaagaactccttcaggaaatgaaggagttctattctcatattttttccatccgtttcttttcagaacgatcatagtaaggcaaggaataaaaaagtttatatgatgctcgttgtttacaaaaacagcatttgcgacattcatatttattaatgaggagcacatgcggacaattgagtacagttaggccttttttcatatgttccttgcaaacacttatcatgagaatcccccgcttacattctttttcttaatgagagattacttcttttggaaattgttcaaataagcgcagtacttcggtatacgtgccatcttctcgaatatgataaatcccaccatcatacgagcttgcgtatacatcattgcctaattgtctaatggcacttatcccattcttagcaattctaattgggccggtattgacccctagctctggattccacactacgatatagccccaataatctccgctcacaatatagccagagtctgtgacagagaccgatttaatcgaatactggtgttcattatgctggtttaaaattcttcctgtatgcaaatcaaacaatctcacattcttgtcacggctgacaatggcaatacggtctcttttgctatcaatgaatacgtcatttaacagctctgtcgccccgatatatttggcttttaaagacaagctcttcttatctaaaagacagatggtgccttctaccgcagctgtgatgatatgatccccttctacttttaatgctttcacagcacaatcatgtgctttggaacggccaacttcctttaaatgctctgtcgaaatgacatggacataaccgccgtaagttccaatataaaattgcctgtcctcctcgtggaaatacacactgttgaccggtcctgtattgagatcaaacgaaaccatttgctgtaatgattcatgaacaatatgcacctgacttgcatgatctccccacgcataatagcttccatctctagcgacagccactccatttgttaaaacgcctgtcgatttagtgatttcaatcccattttttctgaattttccgtcatctgatgctgtgataatatctcctgcctcagtcagtgcaatatcattaatagatggtgtcgccatttcgacctcatctgatacaactttccccttttcaatagaccattcacaatacgtttttccaaagctggctcctaggatagatttctcatcttccgtccagacaagcgagcgctcccactgatatttatgaggcagcaacgtatcgactaaatcccctgtttcgtaattccacagcttaattaaatggtcatagcctgctgtcagcaagtaattgccgcttggagaaaagttcacccgcttgacgccctgtaaatgagctttaatgatttttttctcctgtaacgtcaccgcatcataaataatgacggtaccatcgtctctgccaagtgcgaacacttctttttgattgctgccgctgattgtgtccagctcataatcaaacggaccgatttcccctacaatttctcctgtatcatacagccatacaagaacgtagccgtcatcacctgttgtataagctttatcgccatgtatccatacagctaatacatctttgctatgtccatgaaattctcttagaatggctcctgtttcgatatcccagactaagcatcttctatctctggacaccgagacaagcaaggtatcctgcttcgcaaaagcaacggcttctacatcatccgcatgaccaaacaaggtgcgaatgtgagtatgtgtgcctgtatcatacaattgaatggtgtagtctgacgaagcactggctaagtactttccgttttcagaaagagataaagagttaatgatatgctcatgacttccaataaacgttccttctcctgtcgcccggttccactgataaatacagcggtcatagccgccagtgtaaacaatttggtcctgctgagttgataaaacagatgtaattggtcctctatgcataattttacactcccacctttatatgttgtttttgacgagtcattacacgaaagccagtaaatcgaaaaacagggtctggatgcttcccgtgtcttctggcgactctgcataaatctccgcctcttgcaaaggagccgccttttaaaatgtagtaatcactgccaagcgtttccgttaaatcatctacaacctcaatgccgccttcgtacacatgatatttgctgttgacccattcctcgacgttgccccccatatcataaagtccgaataaggatcttcccttttcgtaatggcggacaggtgtcgttttttcaatatttgattcgtacgtattacagtaagaagagtcaaactcatctccccaaggatattgatttctcgtgttaccccgggcagcatattcccattcttcttcagtaggaagcgacacgtctatcccgagtttcccgcttagccactggcagaatgagaaggcttcctcgatctccatgccccaagccggatgatctttcccgccgccaagttcttgattcgttaagctctcagggtacgactggcctgtttcatcacaataactttgataccattcattagtgacgactgtatctgaaatgaaaaattcattgatatacggctgataggatggaaattctttgtacagccatttttgaaattttttctcacgaccgtaagttggattgagaagcttgtccttccagaattctgatgcctttttcatatcttcttcattacttccgattgttgcatagccgcttgggatttgaatccaattgatttcaggtttcacgcttttctcccgccttctttaaagtaaactcatctactgattaattaattttttctcatcgaccatatgccctgaggctgcttttgcttttaaataggcttcattatagagagaggcttcgaccgtatgatcaaaccgcaaaacaggaagaccgtaggcagcaatggaatcgactttatctggattgttcgttaggagatgcattggtttccctttgtttaaatagtgcagaacagccgctgcctcctcgtaatgccggtcatcatcgccgcatccaatcaggcggttggcttcaaacgtatccagctgcatttcctgtaatttatacgtcaatgctttcgccatcagcccaattgaccgcccttcttgattggccatatagacaagcatgccttttccgtaatcggtgatttttttcagcgataacgcaagctgtggaccgcagtcacatttcagtgacccaaacacatcccctgtttggcagacactatgaattcgcacaagcggcggcatttcattttcaaagtcgccaaataagagacaagaggaaaaggtttgctgcgcggtactcatttggacaatagattcaatcgttggttttgtctccccttcaacaggtgcgaaggcataccacttaaatgacacttcttcatgttgaatggagatcggcaggttcactggtcccacgagcaaatagtttttttcttgaaaggtaaaatgatgaatcattgattgtaattcatctacaaacttattcatttgtctcccccctattcatcgctgcacccaaatcgactcaggaagcgcagtgatggtggtgaatatgtgtccgcactcatggcttaaaagaacatggatatgcgtttcctctcatcgttcagaccttgattccacctattctagcgatagttcaatcttggtcttttccagtacaaaggagcagaattttgggttcatcacgcctttctcttacatgatgcgcacaggctctttcttagaatgaacacctctgctacgtctgagtgttcacctttgtactagattttgacggcaatgacatggtgctggcttatgccggcttttgcttttaatggtgtaatcgatacaagctccagacctgatgaacaaattctttctccaagctgagagtctgaaaatgaaaagtggaaacggccatcttctccgattagccctgttctccactcttctccccatacaacaagtgagaagactccgccttcttgaagcaaagaggacacctgttttaaataacgctcatgatcatcagggtgctggtgatgaaagcagccatgatctaaaattaaatcaaactgcttttcccgtccctgatccatcgaccaggacataaaatcttgatgaaaaaaatagacagggaccgtttctcttttctgtaaccctccccactcctcatgctcatacaggtcgatgccgacatattcggaaagtccgcttaaatgttcaagtgcccggccgttcccgcatccgatatcgagcacagaagcaagtgcatttttttcccttgaacgccaagcttttaatgacatcacggctgcatctgttaaggatggatcagtagaccacatatctgttcttttctcataatgttcttgaaatgccatacgcattttttctagatacaacccactgtcttcatggtataaagcctttttcatcacaggacctccttctatttaaaatcgacttttcgggcaaaggtcatttccaagccaaaaaccttatgttaaaataaaagatggattttttaggaaatctgttttctgaaaaagaagagaagcatcccacatgttcactcttctttttcagcgtgcatcctcatatgcagccatttgaaagctgaagcgcatcagcttgttttctctttttttcatatgagttcacctccttcaccgttcgatcaactcacaaccttttttgaaaccgctttctcctctgtacaaaaacatgacgtcttttctatatctcttgcaaagtgatcatagtagaaaggtcaatctactgtttagatcggctgccatattttcttcaagtaaaagaccgttttcttatgtgttagtagacatattccgagtaagctttttctcttaaaagcacttataccttggttttatgacaccacctttcactagaataagccttgaataaacccttcagaattttaacaactacttccataatgactggaataagccaaatatattgtttttagattattttgtcaacaaattatttcctaaacattaaaatgaattttctaattgaaaatacaggtatttttcgtggttttttgacctcaaaacacttatttctacacaaaaatacaacataaaccaatagaactaagaaatttatctactaaattacacaagatttttattacattttgaaacaaaaccgaaagatacaatgattatttcccgaatggttttttgtgaaatttttactattcttttcttatttcctatctttttctttggtatatctgcattttcaattagatgttttactgtttattccaatctgctattttttctaaatatagtaaaaaagatgcaacctctccttcaaagatgatggcatgaaaaaaagccccttacaaaagtaagaggctttttctcagttggcgtttatgcccaagttttcactttttcatggtctgtcacaaacagaaggacttttccttcatctaaatgttcttcaaatttctcagcttcttctttagagaaaccaatttcatggattttatttcggagctcatcaccctttttactaaagatgttcccaacagcatgtttcagtccaacttctcttggacctatcgtattggcatctgcattcccagcaatacgctctgtacgatcatcgtcatgggacagaacataaatgtcctctcttgcaacaccgagtgattttaattgctctacatctctttgaagtgtttcatcatttgaatactctcttacaacaggtttcattttttattcctcctttagcgtcttacgaatcttttacccgtcacttttatcattaaaccttccttgagcacatccattttacattgagtactaaccatgcctattgacttatttttgacaaaaaccctgtaaaaatgactaaattttctgaaatattgtgttcatccctgctgttttgttgtacaattcttgtactggaggctagaaatgaggtagagctgatgtattacttttcagcggagcagcagtttaatgcttgggttgtcagtgatttggtgaaacagctttttcaaaagtggaatcctgaagaagcaaaagcagagccgcttacattgtttgctgaacagcactttcgcatctccattgattatctcttttccatcattattaacattggagatatcgagtcgattgaacaagatccacaagacctgttgtcctcatacttgaatatcctttttccttttgtgacgcgcgatatgatgaaagcctccatgcaaaatgcgaacgaatatttgttaaaagaacgtgatgcggacgtgtatcagctgtttggctgtctgccgccgctcctctctgttgactttcaaaaaagtagtcctcatctatgagatggcggctgcttttttgtatgtgtttgaaatagaccgtatgttttgaatgaaaagaagcatcatgttaatgtaaatctaggctgcaagtgaaagggaggatttgacatgagtcagcaaaagcaaattcaattagccaaacgtccacaaggattacctacaaaagatgtttttcattttgaaacagtcgatatacctgtgccgcaagatggtgaagttttgattcaaacgaaatatgtttctgtagatccttatatgagaggacgaatgcaggatacaaaatcctatacacctccattcaagctaaatgaagtgattcagggcggtgttgtcggagaagttgtcgagtctaaatcgcctcaatttgaaaaaggtgattttgttctcggattccttggctggcaagaatattccacagccaaagctgaatctctcactaaaattgatccatctatcgcgccattgtcctattatttaggcattttaggcatgccagggcaaaccgcttatttcggtcttcttgcaattggccagccaaaagaaggcgagaccgttgtcatttctggggccgcaggtgctgttggttccgtcgtgggacaaattgctaagatcaaaggcgctcacgtcgttgggattgctggatctgatgataagctggcttatttaaaagagctgggctttgatgaaacaattaattataaaacaacaaaagacttagatgatgctattgcaaaggcgtgccctaacggcgtcgatgtgtattttgacaatgtaggcggcgaaatatctgatgccgtgatgaatcatttgaaccgcttcgcacgtattccagtgtgcggcgcgatttcgtcttataacattagcgcaagcgaggacattggaccgcgtgttcaaacaaaactcattaaaacaagcgcattgatgcaaggcttcattgttgccaactattcagatcgttttgaagaagcagcaagagatctcgcacaatgggtaaaagaagataaactgacttataaagaaacaatcattgaaggctttgacaacattcctgatgcattcctcggactattcaaaggggaaaatgtcggaaaacagcttgtcaaaatttcataaaaagaaaggaccctccatgtgggagggtcctttttttatgcttgcttgggcgcaaggtgcagctgaccttgcttataaacaatttcctgaagcgaaagatttagctttttcgccatttttttaagcattgaatgctcttgaggtgtgactaggctgataacagctccttcttttcctgcgcggccggttctgcctgaacggtggatatagccttcttcgtttggcaggtcggcatggatcacgtaaggcagatcgtcaatatcgatccctcttgctgcgatatctgttgcaagaagaagcgggaattcacgttgttcaaattcctttaagatgatagctcgctctgcttttttcgcttcactatgaagaacaccgaggtcgacatggtgatacgctaatttctctgcataaatgcttagattcgtaatatcacgcacaaaaacgagcgcatgcatgtcctcaagccgtgatagcttttgcagaagttttactttgtcacgctggtcacataatagataatagtgtcctactttctgcgcttcttcctcacttctagcaattttcaatacttctggttcagacgtcatttctttaatcagttgaaccgtttcgtcttttaaggtcgcagaaaaacaaaggatttgtctttcttttagtgtggatttaatgatcgcttggatcgttttcatatgctctggcacaagaagctgatctgcttcatctagcacgatcgttttgacttcgtgcattttcagtttcttgattttgattaattcttggacgcggcctggtgtcgctacgacgatattcgggtgtttttttagtttttcctgctgctttttaatgttcgctccaccaatcaaggagaccgctttgatgtctgatccttgtttaaactcttgcacaacatcaaaaatttgcatcacaagctctcttgatggtgccaagattaagacttgcgggtgcttgatattcacatcaattttatttaaaagcggcaacacatacgccagtgtcttccccgttcccgtaggcgattctgcgatcacatcacgcttctccgtaatccattctgctgttttttcttgtatagctgttggtttttcgaagccagccgcttggaagttctcttgaataaatggctttgcttctttcaaaaatgcccaattttctatcatgtcgatctcctttatcctcattcaatctatcctttagtatctcaaaatcagctttgaaacgcaatttttcttttgatgcttttatcaagccggacagttcgatataatcatgagaggcactagccgttttgaatctatttgaggtgtaaaaaatgatattatctgttaaagatttaagccatggctttggcgacagagccattttccacgaagtctccttccgtttattaaaaggcgagcatgtcggcttaattggcgccaacggtgaaggaaagtcaacgtttatgaatattatcactggcaagctggagccagatgcaggaaaagttgaatgggcaaaaaatgtccgtgtcggctacctggatcagcacactgtgctagaaaagggcagaacgatccgcgaagtgcttcaggatgctttccactatttattttcaatggaagcagcgatgaatgacatttacggcaaaatgggtgaagccgatcctgatgagctggaaaagctgttagaggaagtgggcgttattcaagatgcgctcacaaacaatgatttctatatcattgattccaaggtcgaagaaattgcgagaggccttgggttaacagatcttgggctggaccgtgatgtgacggagctgagcggcggacagcgtacaaaagtattgcttgcgaaattgctgttagagaagccagaaattctccttctcgatgagccgaccaactatttagatgagcagcatattgagtggctgaagcgctatttacaggaatatgaaaatgcgtttatcctcatttcacatgatattccgtttttaaacagcgtcattaacttgatttatcatgttgaaaatcaagagctcacacgctatgttggtgattatgatcaatttaaacaagtgtacgaagtcaaaaagcagcagcttgaagcagcttataaaaggcagcagcaggaagtggctgaattaaaggattttgtggcaagaaacaaagcacgtgtcagcacaagaaatatggcgatgtcccgtcaaaagaaactagataagatggatatgattgaactggcagcagaaaagccaaagcctgaattcaattttaaggcggcacggacttctgggaaattgatttttgaaacaaaagatttggtcattggttatgatgaaccgctctctcgtcctttgaatctgaaaatggaacgcgggcaaaaaattgcgttatacggcgctaacggcatcggaaaaacgacattgctgcgaagtctccttggagaaatctcaccaatttctggtgaggtggaacgcggagaattccttcatattggctactttgagcaagaagtaaaagagcaaaacagcaacacctgtattgaagaagtatggggcaccttcccttcttacacgcaatatgaagtgagagctgctcttgctaaatgcggattaacgacaaaacatattgaaagccgcgtgtctgttttaagcggtggagaaaaagcaaaggtccgtctttgtaagctgatcaatgaagaaaccaacctccttgttctcgatgagccgaccaatcacttggatgtcgatgcgaaagaagaactaaaacgtgcattaaaagaatacaaagggagtgtcttattgatctctcacgaacctgaattttatcaagatgtagccactgaaacttggaattgcgaatcttggacgaccaaagtattataatcacaaaaaagccttatatctcatgcagatataaggctttttctatttaatgacctgcttgaatattgatgagatgtttccggccaattagcaggatgatcatgcctaacagaacgacagccgccccaacatagtaaggggtgcttgcagtaaaagattcagcaagtacgccggcaatccaaggagcaatcgcgcccccaataaaccgcacggcactgtaagaggatgaagcaatggaacgctcaaccggtgctgatcccatcactgcggtcgtgagcacagtattgatcataccaagaatacccccagcaatgacaattccgcagatgacgactacaacatgtgaagtccagattccaataccgaataaaatcacagcaaacgaagcaaacagaaccacaagagaagtcaatgttccaagcttgcgatgaatgaccggcgctgaaaagacggaagtcacagctaaaaatagtccccatccaaaaaagacataaccaagaccatgctcatccagatgaagcacaaatggcgaatacgctaaaagcacaaagaaaccaaaattgtataagaaagcggcagaagccatcgttaaaagtcctttatattttaacgccccgacagcctcgaataatttcacctttttctgaggtttttgcatcggtggaagcataaacgtaatggctaaaagagcaacaagcattaacaccgcaacgccaaagaatggaccgcgccaagagatcgtcccaagctctccgccaagcagcggtccaaccgaaatcccaagacctagtgcagcctcgtataaaataatggccttcgcacttcctccaacagacacaccgacaatgacagagagagccgttgaaatgaataaggcattcccaatcccccatccccctctaaagccgattaattcattaatcgttgaagaggtaccccctaaagcagaaaagacaataataaaaataagtccgattaataacgtccatttcgcaccaatccgactagagataaagccggtaaaaaacatcacaaaaccagtcacaagtaagtagctcgtaaacaaaagagagacctgacttggagatgcatctaattgtgatgcaatggcaggcaaaatcgggtccacaagtcctatccccataaatgaaatcacacatgcaaaggcaacagcccagacggccttcggctgcctaagcagacttgtacgctgttttaacacttcttcttccttcattccatcagaacctttccttcatatgttcacaaaataaaataaacacactgaggtgtttatttttgtaattgctcaatcgcatgagccgctctatctttcatcgtttcaagatcctttttaaaggattgaatcgtttcaagcttttttgtaatcaattgatgctgcacagtcagctgcgcctcaatatctaacagtttttctaatcgttctttcggatcaagcgacaacaaatagccttctttattcagctctaactgcttccctatttccataaacgattgaagctcttgtaaagaaaagccgagtacctcttttgcctgcattactttttctagttcttccatgtcgtcctctgagtacagcctgacaccgccctctgtccgctttggtgctgataataaaccaatctcttcatagaaacgaatcgtccgtttggtcagtccgcttcttttcgccactcgatcaattttcatccattccattgccagtgcctcctgctcatcaattcatgatttattatacacctttataaccttaacgtaaacgtaaatgtttgggttcttgattctctcgtgttttgatgaaaataaaaaaaaacctgcaaaatgttctgcaggtttttttatttcaatcattttattaagattaaccctctaattcctcaatcatgatcgacagttctgtccagcggtccattgcttgttctagttcttcagcaacggctttttgttcgtccatcagttcttgaatttgcccaaaatcactgcctgcttctgcaatgcttgcttcaagctgctgatgtttttcctctaatgcctgaatccggtcttcaattccatcccattcaagctggtctttgtaagaaagtttttttctctttttaggcgccgcttctacttgtttctcagcaggctttgtctctgtgcgcttcgcttctttttcttgctccatgtaatcgctgtaagcaccttggtagtgtgaaacgcggccatttccttcaaagacaagcagacggtgaaccactcggtctaagaaataacgatcatgcgatacggtcatgacaacgccaggaaactgttctaaataatcctctaaaatgctaagtgtctccgtatcaagatcgttcgtcggctcatctagaaagagaacattcggttcttccattaagactttcagtaaatacagtctgcggcgttctccccctgatagtttgcgaataaacgtccgctgcatggatcttgggaataggaaccgttccagcatttgctctgctgtcactatggcgccatcagatgtcttaacgatctcagctgtttccttgatgtattcaatgatcgtcagctcttcatccatttccttgtgatcctgcgtgtaatagccaatgcgaacggtttgtccaattgtcaattgtcctgaagtcggttgaattttacccgcaagacagttgagaagcgtcgtttttccgactccattcggtccgataaatccaatccggtcgcccggcacgactaagtctgtaaaccgctccacaaggttctggccagcaaatgaaatcgacaagtcttctgcctctatgacttgttttcctaggcgatgggaaccgatggcgaaatccagctctcccttcgcatcaggccctttttgatccatcagctcttcggctctgccgatgcgtgctttctgcttcgtcgttcttgcttttgcccctcttctcagccatgcaagctcgcgtctgagcaagttttgacgcttcgtttcttttacctgagcttcggcttctcgttccgctcttttttctaaaaagacttcataatttcctttatacgtataaagctgtccttgattcaattcgtaaatccgattggccacccggttgaggaaataacgatcatgcgtcaccagaatgacagcaccgctgtattgactcaaatatccttcgagccattcaatcgttgcattatcgaggtggttggttggctcatctaaaatcagcaatcctgcgggctgaattaaatttttagcaatcgcgacacgctttttctgtccgcctgataaagcatgaacaaagcggctcacatctttgacgccaagctttgtcaaaatcgtttttgctgataggttcgcaccccatgcgtcttcctgatccattcgattttgcatgcgcatgagtgcctcttgttttgcctcattttgcggatcatgctctaaatcggcgagtgcctgttcatatgccttcatcgtttgaattatgggtgctgttccagaaaaaatgtaatcgagaatcgtttcatccccgtccatttcgggatcctgctcaagaaattcgatatcaagtgtccctgccttcgtgatgtcaccttcctcaaacgattcaagtccagcaatgacctttaggagcgttgactttcctgttccgtttggtccaatcaatccgatgcgttcctttggttctatatgaaaagaaatatgatcaaacagcgttttctcgccataggttttatataatccttcaacattcaataaactcatttttatcagcccttacatagattcttcctttattttaaatcagccagttgcagaaaactagttttaaaaaacccgcagctgaaaagaatgtttccttttgctgctcgatacactatgaagaggtgatctaaagatggtaaccattagcttatgtatgatcgtgaaaaatgaagaggaggtgttagcggactgcctttcctctgtccaagacattgtcgatgagatgatcatcgttgatacaggctcaacagatcgtacgaaagagattgctcactctttttcagccaaggtacttgattttgaatgggttcagcattttgccaaagcccgcaatttcgctttctcacgtgcaacgaaagagtatattttatggcttgatgcagatgatgttctgcttgaagaagaccgtcaaaaatttcttcagctcaaagagacactcgatccttctgtggatgctgtctcgatgttttatcatgtaggattcgatgaagacggtcaggtgaattttaaatatagaagaaatcgccttgtgaagcgtgccttgaactttcagtggtacggggcggttcatgagtttcttcaggtgtatggaaacatcttaccagccgatatagccgtcacacatcaaaagcgtaagaaaacaaccgctggtgaaccagggcgcaacctgcgaatttatgaagacatgctggcaaggggagaggacatgacgccccgtgatctcttttattttgccaatgaattaagagataacaggcagcatgtcagagcaattcgtttttatcatgagtttttagcgacaaaacagtgctggattgaggatgaaattcgcacatgccaatatttagccgactgctattatgcggtaggtttcgaggaagcggctttatcctcattattacgttctttcttatatgatcagcctcggccagaattttgctgccgaatcggggatcatctaaaaattcaaaataaacatcaggcagcgatcttttggtatgagcaggcgctgaaggctcctgaaaacgaagcagccttcacactcacacattataaaacgtggtatcctcaccttcagctttgctattgttattatcagctcggcgatttggagaaagccaaaacacatcatcttgcctccgccgcccatcacccaactcatccaagtgtgctgtataatgaaaaaatatttgctgaacagacataaactaaactatctatcaccacatccgccttccatctcttggcggatgtctcttttttagcaaaaattcgattgtggcgtttaatactttagtggtttaaagcgttcttcaaccaattgactaaattgtcatttcagcatatactaacactcgtcttacgaaaagatttatccattaggaggtcaacatgagttctttatttcgaaaaaagtctctcgaccagctcatgcttgaaagtcaaacgaagcggctcagccgatcgttaaatacgtttgatttaatcttgcttggcattggctgcgtggtcgggactggtatctttgtgattacgggggttgctgcggcaaaggatgcgggacccgcgattattatatcttttattttagctgcgatcgcatgcgcccttgctgctttttgctacgctgaattctcctcatccattcctgtatcaggaagcgtctatacgtattcctatgctacacttggggaatttctcgccttcttaatgggctgggatctcatgcttgaatatgtcattgcactctctgctgtagcaagcggatggtcgtcctatttccaatcactgctcagtggattcggtctgcacataccgaaggctttatcagctgcacctggagccgctgatggggccgtctttaaccttccaggcgcactcattattttgcttatcacctttatcgtctcaagaggcgtcaaagaaagcacgaagctgaataacatcattgtgctgattaaaattgccattgtccttctctttatcatttcaggctttgcttacgtcaaacctgaaaactggacaccttttatgccgatgggcttccacggcgtgattgctggagcggcgactgtcttttttgcttaccttggatttgatgcaatcgctaatgcgtctgaagaagtcaaaaatcctcaaaaggcgatgccaatcggaatcatcggtgcgctcggtgtttgtacgattttatacatcggtgtttcattcgtcttaacaggcatggttcactatacgaagctgaatgtcagtgaccctgtcgcatttgctcttcaagttgttggcctgaatagtgtggcgggcattatatccgcaggtgctattattgggattacgacagtgttaattgcacttgtttatgctcaagttcgtttaacctttgccatgagccgagatggactcatgccgaaaatcttttcaaacgttcatccaaaatcgaaaacaccggttgctaacacttggctcacaggtgctgttgcggcatgtatcgttggattcgtcaacttatctacgctagcgaatttagtcagcataggtacacttgcagcctttacagtgatctctatcgctgtgatcgtcctacggaaaaaacatccgaatatgaacacagcttttaaagtaccctttgtaccttaccttcccattattagtgcggtcatttgtatgatattggctgctacactgaaatgggagacatggagagccttcctgatctgggtggccattggtgtcgttgtttatttcacctatgcaagacgaaaaagtcatctaaatgaaacacattagaaaagagacacggggtttcccggtctctttttttttgcttaaatcacgctgtttttggctgaatttgagtccaccatatctggatctaacacgcttgaaatcggaatgacaagcggtgaacaatctccattatcctctccaaatccttggttcattttcatcgagagaaaataatcgatctgctgataaggacctagcgtcagtgatgcaccccgatccattgcattgattttaaaagcaccgacattgacgacagagggtgagaataacatcacacgtcacttcctttgaatgggtttagctgttggtgaaaaagaggcaggtgagtccacttgatctcgatcatctacatggctttttgtcccgacaaaaccgctggcatctccaaaattttgtccgtacccctgattttttttatctgagttttgccactctgctaacaaattttgtccgacattcaccgccgacgcattttcaaaggaattaatttttaacatgaaaatattaatattgatatacggagttggttgaaccacagataaacctcctttttataggtatatgcaagcacccatcaagtatgttaacaggaggtcttcacatggacttcgaaaaaatgaagcagtggatggatattgcccagcaaatgcatggggacgatttttggaaaatgatcttcgatgatgagcaaagatctccttttatggcaaatggtccatctccatttacgttcacgcagcaggatcagcgcggcccagatgcgtcgttcccaccaatcgacatggtggaaaccgcgacagaaattcagtacttaatttatttgcctggctaccgaaaggaagatgtacaagtgttatcatatggcgaatatttggttgtgaaaggacagcgtttttccttttttaatgagcaggattttcgccaaaagcaggggaagtatggtccgtttgaaaagaaaattcggctcccagaaatgattcttggccaaatgaatgcagcctttaaagacggtgtgctttatatcaggctgcaaaaagatgaaggaaaagcgactgctattatcatagatgacgaatattgatactcacggcgtcgatttgatcacgatcatcaatcgattcaatcggcaggatcgtgatcacgccatcagcattctgttccccaaagccattgtttcttttaatcgtactgcaatgattacaaacaaacgtcgaaccaaacgtcatggacgatcctgtgcccattgagttcgttttcatatgggcaatgtgtatatgagtaggcagcatgtgcttctcccctttcttgtcatctcaataagtatatatctcacagcttttccatagactagatcaaggcagaagaaaaggttgtggtctacttgaaacatttcattctatcactctttaaaaaaactgaatccagtccatcctcctctgtcagtgagctggaaaaaaggctcaccgctcttgagcaaaaaatgtctgcaccagcttcccctgtctcagaggatacacacattcatattgaatccctgcatgtggacaaaattgattaccatttggagtttggtgagctttccattgaccagcttcaaggcagactcaatattggggcaacctattacacgccaaaggacactcacatcaaaaaatcaacaccacaacaaaagccaaaagaaacaaaaacaccgacggtctcgattcgatcaaagccaccttcgtaacccgctcagcttttaagcacagccgggagccagaaatacaccgcaaggacaatcaccacaatactcatgatatttaaccaaaagcccgccttgaccatatctgatattttcagcacgtctgcactaaaaacagcggcatttggcggtgtggaaatcggcagcataaacgcacaagaagaagccaaagcagccgcagccattaacccatagggctcgataccaatcgcaagcccaagccctaccgtaatcggaatgatcatattggcaacagctgtatttgacataatctccgtcataaacaaaatcgctcccgttaaaatgatcaatagcatgagataagataggccatttaaatgctgtagattttccccgatccaccctgttaaattggtttctgcaaagcccgtagcgagcgaaagcccacctccaaacaaaagcaacagcccccacggcagctgtttcatatcctgccattctaatattctctcaccgtttgttgctggaatgagaaataatagcatggcaccaaaaatggcgatggatgtatcggatacggcggctcctccaaacaaaaagagtttaaaaatccacaaaaacgccgtcatgagaaaaacagcaaacacccatttctcctcttgtttcattttccctaaattctctaatccctcccgtatgaacgttacactcatttcacctgtgtgctctaccttgaactgtaccttggtcaaatacaaaaataagagaatgagcagaatcatcgcaacaggaaagccaaacaaaaaccattcaaaaaacataatttcccgatctaatagcttttttgacatcgcagcaaacacagcatttggcacagatccgacaagtgttgccagaccaccaattgacgctgaatacgcaaccgacaataaaatgcttttactgaatcgctcaagagatggaccagctaagatatcattagccttgacctctttaatcacagccagtgccaccgggagcatcatcagggctgtcgctgcatttgaaatccacatagataaaaaagcagtcgcgatcatgactcctaatacaatgcggtcacttcgtgtgccaatcacccttaaaatgtgtaaggccattcttctatgcagattccatttttcaatggcaattgcgatcataaatcctcccatgtacataaaaacgatcggatctccataagctcttgatgtctgttccatcgaaagcccgccaagtgtcggcagtaggatgatgggcaataaagatgttgcagggatgggcagtgcttctgtcacccaccatgtagccgtccaagcggtaatgcccaagactaccctcgcagcataggtcaattcattttcaggtatgagaaaaagaatgagcaagaagagtgccggtccaagaacaagtccaatcacattcacctttttataaacgataacaattcccccctattgaaagcgcttgtatatttttctattttccacattcgatgatctcttaagaaatcctttaaatcataagaaaaaatgaagatatctttcatagaaacaagctatcattttcatccctttcccaaaaccatgacatcgtgccttggtctattttcataggataaactatacaaatcatgtgcaatcactgtaaaatatagaagatctaatcaaaaattgaggtgttttcattgtatacagatcaacgaaaatcaatttggaaacagaaaaaagtcatcattcccattcttagtatcatcgtagttgctgctgctttctttttcttaaaagattctcttttctcaaaagaaaaagaggctttaaaagcggctcaatcctttacaaaacaattggagaagaaagactttacaaagctggctgatgaggtgacaagtgcgtctttgaaagccaatgacttctcaaaaaaacaactagccgaaaaatacgacaatatcttcaacggaattggtgctcatgatctgaacatatcaaagcttaacatcgaaaaacaggacaaaggaaatgggtatcaattttcctatgatgtaacaatgaaaacgtcatttggcaagctgcacaagctttcttacaagggcgttctctcagaagaagatgacaaatggaaagtcgactggaagccaaatctcatcttcccgcaaatggagaagggagataccatcaaagtcaaatcagatcctgctgtccgcggaaatatcgtcgaccgaaaaggacgtaccctagcagaaacaactggtggaagcgcacttggcatcatcccaggaaagcttggcacaggggaagaaaaagaacgcaatatcaaaaaaatcagcaaggcatttgatatagatgaagaactaatcgacaatcagctaaaacaagcatgggtcacagacgacacatttgtcccgctcaaatcaatgttagaacagaagccgattccaaaggatataaaaggcgtcacctatcaatcaaaggaaatgcgttactatccttataacgaagccgccgcccatctcaccggctatgtcgggaaagcaaatgcagatgatatcaaaagaaatccggcattaaaagcagatcaaatcatcggcaaaaccggccttgaattcgcatttgacaaaaatttacgcggacaagatggcggaagcattttgatcgtccatgatgaaacaggcattgaagaaacattgcaaaagtcagatcgacaagatggaaaaacagtgaagctgaccattgatgcctctttacagaaaaaagcctataaacagctgaaaggtgaaaaaggggccgttaccatcatgaatccatcatcaggggatctattagcgcttgtcagctctccttcctatgatgtcaatctcatgacaaacgggatcacacctaagcaatatcaggcatacagtgaaaacccagatctcccattccaagcccggtatgcgagccggtatgcaccagggtctacattcaaaaccattacagcagccatcgggctggaaacaggtgtcacaaagcctaataaagtacgcaccatccatggattgaaatggcaaaagaatcaatcttggggcaattatcgaattacacgggttcacgataaagaaaacgtaaatatggttgatgccctcgtgtactcagataatatttacttcggacaagaagcactggaaattggcaaagatacctatgagaaaaaagtgaagacatttggatttggcgaagatttgcatatgccatttacaatgaaaccagcacaagtatcgaacgacggcattcaatcggacatcttacttgctgactcagcatacggtcaaggtgaattactcatgtcaccaattgaacaagtacatgcctattctccatttgcaactggaggcaagcttgtctacccacgagtcgttcaagatgagaaaacagcatcatcaaaacaaatcatcaaagaagactcggcaaatacagtgaaagacgcgctcactcaggtcgtgacgagtccaaacggtacagctcactccttacaaattgaaggagctgatatcgccgctaaaacaggaacggcagaactgaagagcaagcaaggagcaacagacggttctgaaaatggatttttacttgcatttaatcctaaaaaagaagattacgtcctcgtcggtatgattgaagatgtaaaaaaccgcggcggtagtggactcgtcattcaaaaaatgaagcctgtcatcgcatctttttataagtaaccgtttagagacacaagcacttgtgtctcttttttctaaatcatgacaatttgctattgttttatagttcaccttatgaataaaatgagaagaatgcaaaattgaaaacagttgaatgaaaggaggaagtctcattggctattgctgctcgtacaaaggataaacctcaacattctgtcactggatcaacggtttatcccattttattgattattggcatttgtcatatgctcaatgacactttgcaagccgttattcctgcgatgttccctattttagaacgctcaatggggctgacctttacacaattagggctgattgcctttacattaaatatggtctcctctgtgatgcagcccgctattgggtggtacacagataaaaggccgatgccttatgcactcccgattgctttattttctagtgctgtcggtatattcgggcttgcatttgcgccttcctttgccaccatattgctttgcgttgtctttatcggactcggctctgccattttccatccagagggctctcgtgttgccaatatggcagctggtccaagacgaggacttgcacagtccatctatcaagtaggcggaaatacaggtcaagcctttgctccgctgatcgctgcattaatgctcgtccctctcggtcagtcaggcgtggcttggtttacgattgttggaatgatggctgtcggtttccttctttatatttcaagatggtacgcaggaagacttcaaaccattcgagctcaagcgaaaaaagctccagcaaaagctgcaagatccgaacttcaccgcaagtcagcactcacagcacttggcattatcgtctttctcatctttgcccgctcttggtatggaaatgcgatatcgaatttctatgcgttttatgcgattgaacaatatggattgacgattaaagaatcacagacttatattttcttatttctcattctaggtgcaattgggacatttttaggcgggccgcttgcagaccgcttcggcaagaaaactgtgattttaatttccttattggcatcctttccacttgccttgctgctgccatttgccggacctgtttttgcttatgttttacttggattaattggggttattctgacatcaagcttctctgtcacagtcgtttatgctcaagaactatttcccgggaaaattggcacaatgtctggtttaacggttgggcttgcgtttggtatgggtgcaatcggatcggtcgctctaggctcattcattgatgccttcggtttaacacctaccatgatcggagtcgcttttttaccgatattaggcatcctggccttcttactacctagtgatcaaaccatctccaaatggaatgaatcataaaaaggaaaaaaccgctcagtgattgagcggttttttcatatctcataaaaatgcgtatcaggaacgtgcttctttgcaataaacccttgctgaaattctggaaagaccttttgcacctgtttaattttttgatgaattaaatcagcatacggaatatagagatgatccactaaattttgttctgtcatatagtaataccaattcagattaaaggtattctcatcaatgatcgtaaaggcagaaaaatgatagaacaagagtggacattcgtcgagatacatatccccttttacaacggaaagcttgtagttttcaatattccaaatcgcggcattggctccttttgaggtcacgacatggaccccttcaaaatcatcgatccatctttcaacataccgctgatctccatacgtcttattttttgtatccatttcgactgtacagtgtgcaagacagttttccttccattgtgtgatcgcctgtttggcaacgtctgtgttgcggcagccgacaaatccagtattaaagcggccggacaactcataaaagtgatagaaccgctcagaattcatatgatccgtcaaaaataaatgagcaaggggattctcagcaaaaatcgcctctggatcatgataaaaatacaaatccgtatccaaatgggcgagataatctgcttctgaggattcaaagattttgagcagaaaagctggctttaacgtccagcaatactcatggaacgtccgatcaccctttgcctttcgcagcttggcatcttcaatatcttcaagttgttcatattgaacgtgcggatgaggaaattcacttaacaccttgtaagccaaagggtctgcacataaaaccgacagcttgaatgaatgagcggtttgttcaagcgaatgaatgagcgccaaaagcttaaaaacatgggtattcgacacaatggttgtaaaatgataagacgccatctacaacacatccacttgaaacaaatcaacgcgtaatagctctttcgtcagcccctgaatggcttctacaagcactgtgcagccatattcgtgccgtgcaagctgcgctgcctctgacagctttttcaaagagacatgtctagcggttagctgatctttattatcgcgtttgacgcccacattccgctctgtgatcaaatgaagcagctctaaaaaataagagagcagaccatcgaatactggattttcacgcagctgccgaacctcttttacaatgtcatttgtgacggtgtgtgaaaacggaccagagaaagccagatggacatctatggcatcaatattgttgtacttctcgcacatatacaaaatgttatatttgatgtcatcaaatgaagttaaattacttggatgttcctgatgcacgctcatgatatcctcccgcaattcaaaggagagaccaagctgatgcagacgaatgcctaaatcataatcttcaaacccgtaccgaacgatatgttcatcaaacatcccgagcgcgatgacatgcttgcgtttgacagaggagttattcgtaataaaaaatcgccacggcagctcataagagcctaaatcataattgtacgtgcgcaaaatgtctttgagaatatcaataaactcagactgcaaatcaaagcttttctctagaaatgcaccattctccacttcttgcatggataaaagaggcgttttatctttcattttccgctcatacaagccttgttttttcaatcgcttgatatgatccttatcaaatgcttcgtaaaaataacgataaatccgcttccagcatacaccacaaatgacaaggtcctcttgatcagcatgtgcctccgcatgcttttgaataaattgcggctctgccagcatatcgctgtcatggaatatcagcaggtctccctccgcctcgcgaatggcatgattgcgacccttggcaatcccttgattcacaggaatacgtacctttttaaatgggaaattcacctcaatgttctccagcatttccatcgtgccgtccgttgacccattatcggcgacaatgacctcaaacggaatatccgtatcctgaagcgttaaggaaaaaagactcccttctaaacgctccttagcgttatagctcggaataatgacgcttacctttggcttttcattcatgcgccatcctcctccaatttggcatagccgttaaacagcggatcgatctgctcaacagattcaatcacatggcgcagcacgtttcgataggcttcttggaaaaacggcagatcatctctccccttctcatggatttgctgcatctcatccttgctcacgatgcgaaagccgctgaaatgatagcaaatgagcggatgcccatcatccagcaaaatccgtccattttcttcccgataagaatgctgcccatagttccaatgaccaatattcacgccttttgtttgaatatcttccactttttcaaacagcttcggcatatgatcgagatatccttgatcgccaaacttgccttcgcccggcgcatttttgcattccttcaagcattcttccttccaccaactgaggcattttcggccagcttcatctcctttaaaatgcaggaagcctgagttatagcggcctaaaagcttctgaagcatcttcacttcctcaggatcgaagctcggaatcacaatatcccctctcgaaagtaaaacagaggcatccggctgatgttgaaaaatcacttgcgggctctcataaaagaacaaatccgcatcaaggtaggttacgccctctgcctgctcctgttcaaataaccactcaatccacatcggctttaacgtccagcaatattcagaggcatcccgttcctcttttttctccagcagctccggggtttcgagctcccgtacatgaacgagatcgacatgaggaaaattcatttgatgaagcagatcaaatgcagcatcatccatacataacgtcttgatgacagcatcatcttctacttgcttcaatgataagaaaaacgcaatggcttgataaagccttccacttgatagaaccgtacaatatatgctgttcatctacttacacctctatttttgaaagaattcgcggtaccattcaatcgtcttctctaacccttcatcaatggagtagtcgggcttccaatcaagcagctttctcgccttttctgccgacaaatattgatgctttatctcatgcgttccttggtttaaaatacgaggcttcagttcactgcccattgcctttaaaatcttatccacgagttcaagcaccgtcagctgaatttcattactaaagttaaatgcttctccagcgagccctttttcctccatcttctcagctagcagcaaataagctttaactgcatcttcaatgtagaaataatcacgaataaaagtcccatcacttctaatttcaggcgcttctccttccagcacaagctggatggtttgcggaatgattctgttgaaatttaaatccccgcctccgtataaattgccgcagcgtgtaatacaaactggaagaccatatgtgttgtaatacgtgtgagaaattaaatctgcacagctctttgatacgtcgtacggatgtttcccatttagcggcatgccttcatcgtatggaagctgctcctgatcgccgtatgctttatcacttgatgccacgatgactcgtttgatcagcggctgtcttctgcaagcctccagcacattccatgtccctaaaatattcgcttcaaatgtagaaacagggtgtctatttgcaaccccaacaatggcctgcgccgccaaatggaagacagtatcaatttcatattctcctaacgcacgttcaatcgtttgcatatcctctagtgcaccttgcaccacattcatcttttcaaattgactgccttgatataaattcgaccttggcacctgatcacgcacaagtccagttacgtttgccccttgatcaatcaattccttgacgagatagcttcccaatagtcctgtacatccagtcacaaatacatttttcccattccaaaatccgctcatgccgtcaccaaaccttccatggttgttttccatttgtccacatgccattgatttccttcaggttcttgtacgtatcgatcgctgtccaaaatccgtgatgctcataaaccgcaagctctccatcattcgccaaattttgaagaggctccgcttcaaacacacattggtcatcgtcagtcaaatagtcaaatacctttggagacaacacaaaaaatcctccattgatcatcccgatactgtctgtcttctcagagaaggattgtgccatcccgttatttaccttcaacgtcccatactgtgacttcttttcaattcctgtgacagtcgcagctgccccaagctcctgatgacgcttcagcagatgaaacatattaatattggcaagtccatcaccatacgtcatcatgaatgtctcatccccaatgtagtcctgtgcctgctttaaccgtccgcctgtcatcgtattctcacccgtatctaaaaaggtaattttccagttctctgactttcctaagagcttcatgtcccctgtcgccatatccagcttcatgctgtgatgccgccagtcatagttcaggaaatactctttgatcttctctcctttatatccaagcaataagataaactcatctactccgtaatactgatagattttcataatatgccatagaataggccgatcgccgatcatagcaagtggtttaggaagcgcttgtgtgacctcactcattctcgttccctttcctccgcagagaatgactgctttcatcttctcccctcatctctctatgaaaatttttgattgaaaaccttatctttatgcggaaaatcagtacatgtaccctcatactttgtccgacatcaggttttgaatctactctattcatatgtcgaaatgagagagggtgccacctagcatttaactatttttacaaataaaaaagagcgagatttgtattctcgctctttcaaagtttaaattgtatattatcagggtagatggtatgataaacatgtgcatcaacagcacaaacagcctctttttattaagagactactagatgaaatgaattcaagtggcagcttgcttcattctcaatatgaatcacggaggtgaattcccatggcacaaaacgtactttgtgaagtgaactcttgccgtttttgggctgataacagctgtacggcttctaccattaaaattggtaaaaacacaatgactgatgtgactcgcaatgctgaaactgattgcgaaacatttgaaacaaaataagtggtttttctgagatgaaggaactggcaggttccttcttttcttttatcattctatcaagaatgataattattatcaagtgtttttcactaaacatttctcgggaaataatgacacgatatttctccattcgttgacgattttcactcctttttctatactcaacatatccgaagaagaaaaagtggtgaccaatcaatggattttacgatacgttttctatcattctttgtcgtagaaatcgaaggcaaagatgaacaagcaaataaacggttcaagcattatcaaacattagatcaagaggaatttgaacaaagtgagctgaaggactttttagatggtgagctaaaaaaaatcgtcaaacgaaaagtggacagacaccctaaatctgaacaagtaccaaccaaaattggccgattcattgtcgaacctggtcatgagctcgattcaaatccaaactacaatttatttcatcagacgagatttgccgatacaaaagaagtatttaacgaatgcagtgaacagtttgttcgcacgtatttagatacaagtgctgtcagaggcggcgtttttttagttgcgtctgccgttcctaaaaagtacttcgatgactcctttgtctttattatgaaatgcgattttgaacagaaagtcgcttctatcgctgatacatctaccttgatcaaaaaagtagaaatggcgattacgacaaaaaatatgaaatcgattcaatacccgtttatgccagaagagggcatgacagaggaagctgaagtgaaaattcaccaatcctcacacgctcgttattttgaggactttctgaaattcgtcgaatacggagaatctatgcctgaaatcatgaaatcccaggtcatgaacatggtgcaggaacaagtatttgaaacattacaggatgaaagtgaagaattaaagcagttcgaagaggatcttgaaatatgggaagcgagtgaaaagcgagaaattagagaaacactcgatacagaacaggtcacactagcagcttctcacattgtggaacaaacccctgacatcacaatgaaaatgcgtctaggtgaaacagaaatcaaaggacttttagccgactttggccactcgatccatattgcaaaggtcaacaatcgatatgtcgtgctcgttgaagcagaccaaatcgtctttgaaaaaggaagcacgcctgttgaattccataaaccaaatgggttaaaagaggttgtcagccagctcacgcaaaaagcctacgattcagacttagaataagagaatatgactgcctcctgcgatcagctgcatgaggcagttttttatatagcgctttatttttttacgctgcactagaagaaacatgctgcccgcctcttacccacatgctgacaagcatgaagcttatgacgagcatcagccaaaagacgctgtttgttccgaaaaactgaatcaatgtatacccgcacaaaggtcctaaagcagctcccatatcttgaacaaaagaatagctggcgagaaagcggttcttatctgtttgagcagaggctttttgaaaggcaagtgtatcggtgaacgttgtgacaatcgttgccagcagctgaagcaaaagcagcatcaataggaaccagccgcttaccttcagcatgaccccaagaaaactgagccctccaaataaaagaaacatccagcatagcattcgttccttcatcacaagccgatcaaaccatttacccgttctcggtgcgacaaagggttcccatccccacctgattgcttgaatcacaccgcttaatgccgaagctccgatgacaaagccaaacagagtcaattgattttggtcgatctttgcttcaatgacatgactcagcgtggatgcgaataaaccttggatgatcagtgcgatcagcatgcctgttatcagtactttaaccacatctcgtgtaaaccacttctgtttgatgccctgatacacctgcatgccttctctcttttcaatttcatccaacgatacataaaaaatgcaccccatcaatgtgagtaaaccaaagactagcgtcatggactggaagccgatcaagctggcaaagattccgccacataacatgccaaataaactgccgagccggtaaagcccattataaagccccgtcaaatgcccttgtgtgccttcgtccatttcagccaaaaccctcatcccgctcattcggagtaatgtccaagcgagcccccatgcgcagcggcagatcaatagcagccaaaagccgctcatcccatataatatcgtggtcactgacgcgatcaaaatcgcgatcaatacgcctgtcttcattgggatatatcgatagagccaccatacgacaggtgctagcgggatacgaatgaatcggttaatggacagcagtaacccgacctcccaaatggatgataaaccaatctctttccaatagaccgggagaacaatatagagcattgaatccccaataagtgcaaatgctgtgatgagcgatattgacacaacttgcttttgacgacgatccattttttcttcccccttcgctacctttacgataagggatgccttataataaatctaatgaatgtttttgattgttttatcaaaataattgataggtggtgcaaagttgaatttacatgcccttcggatttttgcaaaggtcgcagagacaaaaagcgtcacacaaactgcagatgcactatctttaacacagccagctgtgacggctcagcttagaagcattgaacgagagatcggatttcgccttattaaacgaaacggccgaggcattgcactcacagaaatgggaaagatgctgcaaccttatgcccggcaagtgtttgaggctgaaaaggaagtagaatatcagatcacgctattacaaaacgggaagaaggggcgcctccgcatcgcttctacctacgtaccactcaactttttactgcctgattggctggctgcatttaaaacgtcagctccacagacagaaattgaattaaaaagcggaaactccgctcaagtgatagagagcctgcttcaatacaaatcagatgtcgccatcgctgtaattgaagatttgcatcatgaggaaattattacctctcatttgacgaatttaaactatgatttcattgtgccagcagaccatccgttgaacggaaaaaccgttctgctagagcgcctgagtctagagccttttttgatgcgtgaagaaggcagctccacaagagataagctcttttccctgttcacctcgaaaggaattaaaaagccgactgttgatttacaattcagcggtgttcatgaagcgattcaaatgatcaaagctggctatggaatcacgcttgttccccgtgatgcggttcagggcagtctcaagcggaaagagattgggcgagtatatatcgaaggcatagaaatcgtcagacctgttgtgatctgcaaacgggtgaatgaccttgaagaaaatagaaccgttgatgccttcctgcaaatgaagggtatcggtccatttaaggagccggctgcaaattaaaaaagtgcctgtatgagaaacaggcactttttctattctgctggctgcacgatgtcatacggtacagcctttgaggctctcactaattgttctggtgtgatcagtatttcatttccccattcacctgctccaactcctaatatttcttcctctaatagcgaagcttcgatgatggtgcggaaaccttctggctgccagcaaaacggcggtattgaaccaattcggtagcctgtcacttctagaaccttctctggtgatgccattttaatattgcgggagccagccgctttctttagtttccccgacttaatatgctggtctgcgccaaccatcacaagcagctgctccccttcccctgtttcaaaaatcaatgtcttaatcatttgtctttcacgaaaaccaagggctgctgctacatttgctgctcccttctctgtttcagaagaaaatgttttgatctcatatgggatgctgttctgattcaagtattcatgtgctggcagaactttcattgatttgaacccctttccttacgatgtctttcatttagcttatcacaatcctctcatccttaagatgtatttttcaatggaaagcctctgagtcgttcttcaccatgctatactgaacttgtttttggaaaggagccggttggatatgggaaatcagttttggtactatacaggcagtaaaagccttctcatgctaagtgatattctatttgtcatgacgatcacatttgtgatctatcaagatacacaatctgttgcgtatgcggctttatttccgctaataagaacgctatgccagctattagctgggctcctctctcctgtgttggcagatcactttcaagcaggccggcttttgaaatgggtcccgcttttacgtcttgggatgcttatcgtctttacagcccaatttcatttctttcagcagcatatggtttggctatttgttgcactcattctcatttccatcacaggcggattcattagtcctttattacaggccatcatgccgatgcttgtgccagaaaatcagcttgtgaaagcaaacagtacagcttccatttttcaacaaacggttcaaattgccggctattcgtttactggaatgctcgttctgttcattggtcccttttatttaatgtggatcacttgtttgatgatagtgttatcttatttgtttttcttccctatatttcctcttcttcagcaagaagaacccgttcgaaaagtaaataaaatgaacagtttcaaggatggctggacgatcatttggacaaacaaaaccattcgtaccctgacctttatggatgtgtgtgaaaatatagcaggcgctgtgtggatcggggcgattacgcttgcctttgtcacacaagatttaaacaaaagtgaagattggtgggggtttatcaatgccgcttattataccggcgccattctaggcgggcttttggcggcgtggataagccgattcattcaaaagcagcttcttctctgtatggcagctggttcattcatttatgcagtgctgaccattgtctactcactgaacagcctgccgtggcttgctttgctgctttgtattttaatggggcctgcctatcaaattcgggatgtttcgcagcagactattcttcaaacggaaacgccagtccgagatttatcaaaggtgtactcggctcattacgtcctttcctctgtatctgtcggtttatctattttctttgttggattgattgcagatgcattcggagcgaggactgtgtatttgctgggcggtttgtttgtgctcatctgttccgggattgccatcctctcttttatgaggcagaaaaaaaagagcggctgattcatgcagcggctcttttacttttcctttaacattgcgaacatatcacgcgccatcgcttctaaaatatacacaacgggcgtctgtgtcgtaatattggctctgtgaacccgttcgtctgtcacgtaataagcaatgtttaaatcggaaatgcgtgaaatcgtgcagtgctgattgtttgtaatactaatgattttgcttccttctctttttaacttcgaaatatgatcaatcgtaatactgttctcccctgatacagacagcacaatggtgacactattgtctaaatactgcatattcatcgggaaaaacggatcattgatgtaaaatgaaaatttctcaagacttgaaaagtacctcgccccatactgcgccaaaataccagagctgcccgtgccaataaacagcacatttttcgcatcggcaatgagccctgctgcctctttaatcttcccttcaaagtccccttttagtgtacgttcaataaattcatatagaaagtgctgggtgctttttaaagtaggtgtccgctctgattctaaatacattttgagtttcactttaaactctgaaaaaccttcacaattcacttttcgacaaaagcgaaggacagacgaggtggagatatgggcagcatctgctaagtcccgaattctcatatacacgaccttttcactgttttccatgatgtatcggtataaagcgctttctagttcattaaagctggaaatgacctcacttgaaaacatctgacttcccctttctccaacagcatgtcacaatgtgtttcttttatgtaacaaatctctaaatagggcacccttgcctaaagacgctgaagtcatttacgcacgagatgctctcacgataagctatagatgtacaaacaaaagaattggcttttctctattataacattgcgcgttacattattcggaggtgcagcacatggcaaaaggattaaaggttgtcacaattggcggaggatcaagctatacaccagagcttgtagaaggatttattaaacggtacgatgaatttccgattagcgagctttggcttgtcgatattgaagcaggaaaagaaaagcttgaaatcgtcggagatcttgccaaacgaatggtgaaaaaagcaggacttccaatcgaggttcatttaacattagatcgccgaaaagcgcttgcgggcgctgatttcgtcacaacacaattccgtgtcggtcttcttgaagcacgtatgaaggatgaacgcattcctttaaaatatgatgtcattggtcaagaaacgaatggtccaggaggtctattcaaaggacttcgtaccattccagtgattctagatattgtcaaagatattgaagaactatgcccagatgcatggcttgtgaatttcaccaacccagctggtatggtcacagaagctgttcttcgctattcaaatcatcgcaaagtcgtgggattatgcaacgtgccaatcggcattcgcatgggcattgccaaaggacttgatgtcgacgcaagcagagtcgaggtcagctttgctggattaaaccatatggtcttcggactcaacgtattcttagatggtaaaagcattatggatcaagtcatcgaagacatggcagatccaaactctacgatgtcgatgaacaacattcaagccattccgtgggatgctgatttcttaaaagggcttggcgtgattccttgtccatatcaccgctactactacaaaacaagtgatatgctggctgaagagaagaaagcagcagagaatgaaggaactcgtgcagaagtcgttcgtgcactagaaaatgacctattcgagctttacaaagaccctgatcttgatattaagccgccacagcttgaaaaaagaggcggtgcttactacagtgatgctgcgtgtaacttgatcgcatcgatttataacgacaagcatgatattcagcctgtaaacacgatcaacaatggtgccatcagtgacattccaaatgattctgctgtagaactgaactgtgtcatcacaaaagacggtcctaaaccaatcgctgttggcgaaatgccagtcgcagtcaaaggactgatttctcaaattaaatcctttgaacgtgttgccgctgaagcagccgtgacaggagattacaacacagcacttgtcgcaatgacgatcaacccactcgtcccatcagatgccattgcaaaaagcatcctagatgagatgctagaagcacacaaagattatttaccacaattcttcaataaagtagaagcataaaacagaaccgcacttgtcaaagtgcggttttcttatttctctgtaaacagctggtccatctgagggcgatcatagtctaatagccagtgctgcaagccctcatagactggccgaagacgctcagcatctgccgcaataagatcacagcctcgatcatcatataagtggaaaatcatctgttttgagagattgataagataaatttcataaccaagcttcccgttcaaaatttgattcggtgcataaaagtcctcttggcatatggcttgtagaagtgggcgtaatcggatatcttgcagcttgcaagtcagtgtaaatctctccaatgtcaggggctcatctagatctgatctgacataggtcaaaagctcgtgacgcaatcgattgcgtacttgccggcgaacatatttctgataaactaggagcttttgcttcgttaattcatgttcatgctgcgtatagacatccgtgacaaatagaatatcgtcttctggatcaaaagcatatctgacaattttcaaagcacgatcccctgctttttctaatacaactgatttttctcctaatgaccaatctgccacttcaaagcgaagcccaaaaggccattcataaaaaagaggcggcgtgaggacaagattaggaaaatgcctttttaaaaaactattcgtttgatcgctcatgtcatgtccttccattggttttatttcttattttaccgttgaaactgatggaaataaaattgggaataaactgtcatttcttatatgatagaaagagatggaggtgtgaccaattgaaaaaatggtttttacaggtgttcctcaccgcattgatcactatgtggatacaggctggacttgatcaagtgaacatcattcatatcaccaatgtatggatcgatgccagcagctggatcctgatcttctttgttatctacgcactttttgaatggacagctcacgtcttagcaaaaaggaaaactgctcatcgctgaacatctcttttcatagagatgttttttgttgaaattcttcctgcacaagctcatgaatcacgcccattcctgcctggcttccagcagctgcggcaagaacaagttgagctggcccgcctaaattgtcaccgcatgcaaagacaccgctgacggttgtacgtccaagaatatctgtttcgataccgccatttttcgtcatttgacagcctagtttttcagcaaatggagctgactgcttgaattcacttgcgacaaatccgccttctctcttcaccgtttccccatttgcaaggtgaatagagtgcatttgcccattctcatgatgaatggacataatcggtacatcaattacttggataaaatgtgctgatagcaacgccttctcctcttcagcaaacacttgctgtccattcgtaaacacgatcaaatcctttgtccaattggaaagaagtttagccatatgcaaggcgcgtggattctcagcaatgagagcaagcggcttgtcctttagctcccagccatcacagaaaggacagctaaacaacgtctttccatacacttcatgaatccccttcatctctggcagtatatcctttagtcctgttgccaatatgattttcttcgcttcaaatctttctccctcttgtgtcagtaacgcaaagttgtcctcattgttttgtatctcaacaattctagttcgtttgatttggatattggagtagttttgaagatctgcttcacccgcttgtctgatctcaaacggtgtcatcccatcgtttgtaataaacccatgtgattcctgagtcactcgatttcttggcatcttgtcatcgaatacaatgacctgttttctgccccgccccacaacaagtgctgcacttaatccagctggtccgcctccaataatggcacaatctaatagcatataaatctctcctttttattcaagactttaaagactcttaatatctataattcattcaaaaaaaatcacatcttgaaaaatggatttttttctgtctgctcaatttggctagcgatatcaactaaccgcttttgactaagcgtttcctgcattttcatttcaacatcctgcatggcttgttcaatcaaacaaccatcatgaggcatgaaagaatcatgttctaaagaacaacgaaataaattggtttgaccttctaccgcttgaatgacgtctaaaaatgaaatgtcctctttctttttcagaatggtgtaaccaccttttgcgccaggtgttgattcaatcaatcctgccttcacaagctttgttaaaattttggataaataagtggatgaaaggtcttgcatcttggcgagaggctcaacgccaattgctttcccctttggtgcaagcgttaaaaataccatcgtatgaagcgcataattggttgctttagaatatttcatcagacgattccctttctatctattatagaccttttatatctgtaattgatcataaaagattcaagaagaaaaagcaagtcttgtggatctgcttcttttttcattccacatttcgcatttctttccgataatagaggtaagcacgaatcaaatttgatgaaaactagaaggagtgaacaaaatgtcagatcaacagcacaatgcagcacacgaagaagaagaggaatttaacgtatatgatatgcttccacccgcaggaacaatcattggtgaagcaacggaagaagaaatggaagctgcggcagcattagaagtgagacattacgcctttatgcgtcttcaagactcgtacattcaatttgacggatcttcctataaagaattgctcaaagactttcaagaactagaatttgattctgcaaagttttggagagccatcgcacgacgcctgcaagtcccatacgaatggcccatccgaatcgaccacgcaaacggtcctatttatattggcgaaacagaggatagccgtgaggttgaggagagtgcggagtaaaggaaatgtgaccccctttttgaaaaagggggcttttcgtctccttcacaatccatcgattgaaaaaacaaataagcaatatgagcattgtaacgcccatattgcttattctcgtgttatgttaactctggccaaaaggcttgatttgccacaattaagtcatctagaatatcttttgctactttagcactcggcaccgttttcgataatgtaatagcctgccatagtttttgataggacccttcttcaaatgcttctactactaatttttctacgccaacttgctgctccatgagacttttttgaaatctaggaatttctccaaccactaacttttctggaccgttgctgccaacgatacaaggaatttcgaccatagctgttgggtcaaagttcctgattgcgccattgttctccacaatcatcagcatccgttcctttttattaaaagcaatggctcttgctaaatcaacgatataggaagcgtgctcatcaatggctagctttgtttcctttgcagtacctttatcaatgatggcctgacattcactaaaaacaaaggcttcccgtccctccatcacttcattggcacgtgtgaactctatatttgaatgtgccacttcttcatctggaaatagatagtatttcaaatacgtatttggtaccgtttttggatcaagtgcttgaatatctttagccttttttaatgtgctgttccagctcttctgctgttctagttcagatgttccatctgctgcataaccatgctggcttacatgctgaatgacctcaggcattaagctatttccttttttatctcgaatatctgtccaccagccaaaatgattcaaaccataataatctacttccagttctttacgtgaagataagcctaaattctttgcaatcaattcttcaattccaatcggcatatcgcatatgtttaaaattttggcattcggccttagcttacgtgttgcctctgctactattgctgcagggttagaatagttcaacatccaagcttcaggagagtatttttccatataatcgacaagttctaatacacctggaatggaccgcataccgtaagcgattccccctggaccgcatgtttcctgcccaacgactccatgcttcaatggaattttctcatctaattcacgcattgcatatttgccgacacggatatgtgccatcacaaaatcgacttgagtaaaggcttcttctgggtcagtacttgccagcagtcgaacttctggcgctcgttcttttaacataatctcacaagcatctgcaattgtattttgtctagtttcatcattatcataaagtttaattgtatgaattgggaactcatctaaatagtctaacagcatcaaaatgattcccggtgtaaatgtacttccgcctccagcgatcgtaatattaaatgttttcatgatatccagctcctttttcaatctaatgaaagttttgtttcaaaggactctctcacttgcggtacacttaagccaacgatgatttgaatgctttgaccactcttagccattccatgtgccagtttattttttgtaaagtattctctatctttcaccaagctagggtcaatcactgtaatacgcagacgcgtggcacagtttgttacatctttaatgttttctttaccgccaaggccttctaagaaataaacggctttctcttcgtactcagacgcataaacgggcacttcctttttgttatgatcctttttattagcattctcataatcttgttttgtatatagcctcgtctcctcctcatgttttcgtcctggtaatggaatatcaaatttcacaatcacccatctaaatatgacaaaatacaatgctgtaaatagacatccaattgtggcttggatcagataaatccctccatgatttgaagagagcggaatccagttcaaagcagctatttcaataagcccggaacccatcattccgacaacaccaaacatattcatgattgtcaccatggttgctccaagaagtgcatgtatgacaaataaataaggcgcaagaaataggaatgtaaattcaagtggttctgtaattccggcaaataccgctgttaatgtggcgggtaataccaatgccaaaaccttttttctgttttctttcggggtagaaaaatacatcgctagagctatcccgaaacagccgaacatcttaatatttccatgcagtaaaaatccgtacggataaagatccttcaaatcggaagttgaggtcgcaaattcatttaaatgagcaatccaaaatggttttaaccctccatttacagccgctggaccaaactcaaaaggtgtataaataaaatggtgaagtcctgttggaattaacaccctttccaaaaaatgaaacagccagacaccaatataaccagactgtgccatgaacccttggagagattgaattccctgctgaacataaggccatacaaaagcaacgacaaaagcaataggaatcatcacaaagaatccgatgatgacaacaaagacaagcccctggaaaatcccgagcatttcaggcagcttttgatcataaaaacgattatgaatccaaatcacaattccagatatcatcaccgcaccaatgatacttgtatcgagcgtaggtatacccgcaatttcttttacacccgctacgttctcgactccttgcgataaatcaacaccaaaagtggacggccaaagtgtcaaaatcgcatgaatataattattaaacacaagataaatcatcaaagctgcgagcgtcgcacgtgcttgcgctttttttgcaagtgagatcggcaagccaatcacaaatgccagctccatatgattgaaaatcgtccaccctccactttcaatcagtgtccaagccttataccacatcgtaccttctgcagccatatcccccataatcgctggattcttacataaagtcgcaaggccgacaacaataccaaaaaacgcgaataaaaggactggaactaccatagcactgccaaatcgcttgattgcattcataagcatcacccctttgtttgatccataacaccactgtaaagggagcgcttacaaaaaccaataggattgacgtatttagaaatcaagttgtaacattagattatattttcacaggaagaaaatattttcatgttggagggcacatcccatgatattggacaagctggtaaatgaatacttcgagaatttaaataagaatgacctgcacattattaaaacgattcacgatcatcttgaagaaatgaagacaatgaaaattcaggatcttgctcgttatgctcatacttccatctcctccattcatcgacttgccaaaaaaataggtttcgacggctacagtgacttaaagtcttatgtgaaattaaatcatcttactgaagaatcaacacaggatttaatgaaactactcgatcaagatatcagccagacaaggaaatttatggagcagctggactttcatcaattaaatcaactgattgaccgcgcaccatatatttatatttatggtacaggaactgcacagctcgatttggccaatgatgtacaacggcagctatggtcactgcataagaaatctcaagtattacgaagcaagcgagacttaacagatggaatcattgaatttggtgaggatgaccttttatttatcatttctttatcgggtgaatcgaagaatctagatgaaatcattcaattagtgaaaacgagacatatcaaatttatcagtatgaccacattgagaaataacctccttgcacaaaatgccatgtttaacatctatgtaagcagcaccccgtttcctttgtataacaaagtggacaactcaagctttctaccattttacattgtggtagatatgatcgtcagaaaatttagtgagtggaaatggaatcaattgaataataggacttaaacataataggtacagttttggagagaaatagtgagagaatccatattgcttcacaaaaaaagagagactcttttgtctctctcaaaaaacaacaaaacatttttctgactgcttaatgttattcagcagtataatgcccagcaatcagttcatcaaacgaatccgctaatttgaaatctgtctcatcttctagatcaaagtagtgaatcggcggatgttcctttgtttctctataatctaatgcgatccacgtatgaccatccccacaaatgagcacaagtccctcaggcaattcccattcttctattaaataatcactatccatgatcccttcgcctttggcaattcctcttaaatgatcaaatgacacatgatcctctgcccatccattcggctggtccgttggaaaagcatcgtgcagggtataaccgccattttgttcgaggataagcttcttatatgtatccggcagcgtgacgcctagcttcttttccgcttttgcaatgcctttctcattgattttcttaaatgtctcttcactttctatgtctttatcccaaaatgatttcaaataaaatacctccaattgttatttctatctcattttaccatttggagcaactagttcaatagtcctgttcatagaaaaaagagaagggcttcccctcctctttttcatcatgattattcttgatttctcgcttcaaattcatctagcattgcacgcacttcatctgttgaggatgtgttcattaattggtttcttaggaagctcgctcctctgaatccttttacataaatcttaaagaaacggtgcagtgccttgaatggacgcaagcctagtgatgaatattgatcatgaagatcaagatgcaatcttaaaagacctagcagctcatcactcgtatgttccttcggctctttttcaaaggcaaatgggttatgaaaaatcccgcgcccaatcatcacaccatccactccatactgctcagcgagctttaagcctgtttgacgatcaggaatatcgccattgatcgtcaaaagcgtatcaggtgctacttcatcacgaagttttttgatctcaggaatgagctcccaatgcgcatccacctggctcatttcctttcttgtgcgaagatggatagacaaattcacaatgtcttgctccaaaatgtgtctgagccaatctcgccattcatcgacttcagtaaagccaagtcttgttttgacgctgacaggtaatcccccagcttttgccgcttgaatcagttctgccgcaacgtctggacgaagaattaagccactgcccttcccgttttgcgtgacattcggaacaggacagcccatattaatatcaagcccctgaaatcctaactccgccatcccaatgctcatctgtctaaagttctcaggcttgtctccccaaatatgagcaacaatcggctgctcatcctctgtaaacgttaaacgccctttcacactttgaatcccatcaggatggcaatagctctcactattcgtaaactctgtgaaaaacacatctggtctcgccgcctcactcacaacatgacgaaacacaacatctgtcacttcttccattggtgctaatataaaaaatggccgcggtaaatcacgccagaaatttttactcatctttcatccaattcctctcatgacatagcgccttttaagggcatgtccttctataaagtctttcagcaatttttatcattatatactttagtaaggattcaacgcaaaaggagtataaaatgaacaaaatactatcagcactttataaaatatcaaaaatttgaggagacgtaaacgccgttcaaaaagctacttcaggtaaacatgtcacgcgacgggcagcaggtacagcatccggcaaactaatgaaaagatattcaaataaaaaagccctatgcaggggctctttaaattgtaattgccttttctgttacatgataagtgttagaagtaatgattttatcaagtgaccaaccggcagcgaataacacagaaaaaattgttaaactgataaataactttttcatcataacgcctccgccatttttagtatttgttgttgtgctttaatggtcttttttagatattctctattcaattcaaaattccctttttgataatgataatctgcgagtttatctgataactccgctacatcttgccacaaacttttgctttctaaataactgaggctttcatttacctccgattcattatattcttcaaaaagcgcataaatgatttttaattttatcttgttcgtagaatacccaggacaacatataaagtgttctaattcccgagatcgtttcggcatgttcttttatttgaattgaatttagaaattcattttctgcggtttcaatttctccggctctttttttcactaaacctaaattatgatgtattacaccaataatccgttgggctgtttcctcattaagctcttgagccaagctcaaggcttccctataataagattctgcctcatctaagcggtataagtcgtacatattcgctccaaatttgatattacaaccgactcctttcgctttgtaaaactcgcttgttgaatacatttcttttgctttttccaaatggtttaacgatacgaaatgttgatcaatgcgataatatgcatcagctagtttgtaatgaaattcggctctttctatatcatcgggaacattctttaaatgttcttcagcagccttgtaaaaatttatagcagcaacataatttttttggtggaattcgtgcatacctctaaagaagtttgaatagtagtcaagcgttcctttgacgtggggctgtttgttctctatttctctgagtaaatcgggtaaagtggggcgttgttgattcatttcaataggcacaagactttcaagcatgagtcgatgcctaaactccattaattgataatatagcagtaaatcttgatcctcttccatgtcctctatttctctttcaacctgttcttttaaaatctctgcgtccggcacgctgaatgtccttataaatctataccaatcatttatcaatataccaacttgagaagaaagaattttctccactcctaccatcccctttcttgctattccctataatgacatatattatcattttctaaatatttccacaccgaaaagaaaccgcaatttttccataaaaaaaatacaattatatagacaagcaaatgtataacgttgtgaaaatacagtattaaaatactatttacccttaatttggttgttgttacaatttttatgtaaattaagaaaggagtgattatcttatataaaagtcctataagaatttaagacatatgccactgttttttctcaagatgtattttataattgaggcttgaacaacaagatttttttagcactataaacagcctcttcattaaattttcggaggcgaaattactatgacttttagaaagaagtttgttcctgtactattaagcgcaactttattaacttccggtcttggtgcgactactgcgtttgcagcggagccaactaaatcaatagcaccagtacatacgaaggtatataaaacatctttacaacaagccgcaacaaataacagcactagccctattcagtcaaatgctttaacaactcaaaaagccacaaacggggaagtttctactcaaggtgctgtttcatggtcatataaagcattccgaggtgctttacgttctggtggatggttactatcaaaagcattgaaaccctttaatccaaaggctgctgcttggatcagaaagaaatcttctaaaatcgcaaaggtaatggataaaggggaaaagtggacagaaaaacagtttgtaacagcttttattaaaatgggtgcacctaaagatgttgctaaaactttggcaaaattcatcattactcttatttaaataaacaataagtgctattagttttctaatagcgcttttttatggagggtatatatattgtctttttcttatgtgatttcattgacttttttaatacttcttttagtttctatcatattttatacttttttaaggaaaaaaaatgttgtagatgaacccccaggtgctattgctgccgttcttcttattttactaatatgtttttcccttggtttcgttattgctattccgactttcatgctttacctagtatcattgggagtaaattttcttttcggcgaatacataacttatgattcatttttctctttggtgaccttttctttgttagttagcatcatcgtaattttttggtcatttatagttttatttatagggaaaggaatcatttttttgttgaaggtcccaaaatggataacttatattttagaattttttgcttcgtgggctcttatttacttttcaattaaatatgtactaaatatggagatagttgaagtttctatatggggaaatggtgtattgattttatctttctttgttagctttttatacattggtcttgatattatatcctctgcgcttgatcaaaaaaatcaaaatatagaagaagaaccccctatccaataatggaaaagggggtttatttggttcatagcttttactactatagtcatatgtctatagatttttatttaaataacttttctaacactgctttagtctttggaccatagatgtgtaattcattatccggatacattggcttgataaagtttatattattcatctgtgttccagcacagcaaggaaatcagcaccaccgcaaactccttgttctatccattgcttaaatgaaatagctagcgtttgtattccggaagcaatgcccccattaaatttcaccttattttctttaaaatccaaaatgtagattaaatttcccatcaaacctcacaatatcttcctttatgaatttgaatgacttaataatgaaatttaaaaattaagggaccaaataggatttaccagatatcctcacttgttatttatgtgccaaaatattaaacctctctgaaccctcccctcattttttcccttttacagtttaaaacacctattttcgatcacgatgttttgttaacgctttttcaaagtgataataaatttatcctatgatggtagaggaactataagagaaaagagaagtttatttcagttagacaatttaagggataaagacgccacgcactccacatgactcgtatgcggaaacatatccacaggctgtacttcctccgtcacatacccaccatcttcaagaatacgcaaatcacgagctagcgtccccggattacaggacacatacacaactcggtttggtttcatctttaaaatggtgtcaagcagtgcttcatcacagccttttcttggcggatcgacaactagcgtatctgctttgatgccttctttgtaccagcttgggatgacggtttctgcttcgccgaccgcgaattcgacgttgttgatcccgtttaaggcggcgttacgttttgcatcttcaattgcttctggcacaatttctacgccatatactctgcctgctttttgtgctagaaataaggaaatcgtaccgattccacaatacgcatcgatgacggtttcttcgccttgcagcttggcatattcaagggctttgtcgtaaagcaccttagtttgggctgggttcacttgataaaatgagcgggctgaaatggcaaatttgatgtcgccaatcgtgtcataaatgtattcttctccccataaaacggttgtttcatctccgaaaatgacatttgtcttcttcgaattcacgttttgcacaattgaccgaatgtgtgggaagcgtgctataatctggtcaatcacttgctgcttttgcggaaagtcagccgttctagtgacaaacacaaccatcatttcacctgttgcaatcccgtagcgaaccatcacatgacgcagccagcctttgtgccgctcttcgttatatgctttgatgccaaacgcattgcatatgtcttttactgcctgtaccacttcgtcattttctgactgctggatcagacatttttccatatcaatgatttcatgggtacgctgctgataaaatcctgcaacaagtccgccttcgcgttcgccaactggaacttgtgctttgtttcggtaattccaagggtcttccatgccgagtacaggatgaacttttacacggctcatatcaagcttgccgatccgctctaaaacgtcctttacttgtttctgtttaaatagcagctggccttcatagctcatatgctgaatttgacagcctccgcactgcttataaatgggacatggcgcatcttgcctgtgctgactttcctttgtcagctccatgagtcgcccaaaagcaaatccttttttcacacgtgtgaccttgattttcccttgttcgtctggaagggcattcggtacaaagacagggaatccttcaattttcgctacacctgcaccttcgtgcgttaagtcttcgaaggttacattgtagtattcattcttttcaacaggcggtttcattttcaccaattttatcacctcatttgcaaagaaaaacttggcgccataaggaaccaagttcaatctctaccctattttttcagctgttgcttttggcacaataaattctatatgacgatacaggttttcaaattcacctggcagcatgccgccgaattcgccatctaaatttaattgcattttatcttttacatctaccttcacgcgattcgcttttgcgtagatgacattgttatcatgaatatgctcgcctcgaagtgcaaggctgactactcgaatggcttctgctaaattgaccttctttaaaataatcaggtcaaacattccatcatctaaaatggaatctggcgctagcttttcaaagccgcctactgaatttgtgagtgaaacaagaaacagcatgatttctccatgaaacaacttaccgtcatattcaatttcgacttctgtcgggcggatcgaaggaagcatctccatgccttttaaataatacgcaagctgtccaagcattgtcttcagcttactaggcacttcataagtgagctctgttaaccggccgcctcctgcaatattaataaaataatgtccattgactttaccgatatcaagcggcttcgctacaccttctataatggcatctgttgcttttaaaacaccttctcgtggaatgccaagtgctcttgcgaagtcatttgttgttccaacgggaataattcctagttttggtcttttttcaagcggggctagtccgttgacaacttcattgatcgtgccgtctccacctgctgctacaattaaatcaaagtctcgctgtgcggcattctcagctgcttgtgtcgcatctcctgcacatgtcgttgcatgacaagatgtttcatagccagcttgttcaaatttttgcaaaacctgcggcaaattcttcttgaagagttcacgcccagatgtcggattgtatataattcgagcacgtttcattcatcatcatcctatattcattatgcaatctattttcaccactaacaacctttaattatactatgagatttgaaaatggcaacagaacaaccacctaatattagaaatctcctgccacatttccctcagcaagaaagcattctgataagataaaagaaaacgctgtaaaggatggtttgcgatgaaaaagcctgtctattttaatcatgatggtggtgttgatgatctcgtctcattatttcttctccttcaaatggaacacctgaaagtgatcgggacgtctgtcatacctgctgattgttatttagagccagctctcagtgcgtctcaaaaaattatcgatcgatttagcccttatgaaattgaagtcgctgcttcaaattctagaggcgtcaatccttttccgaaagagtggcgcatgcatgctttttatgtagacgccttacctcttttaaacgagaaaggcactgttgatacaaacgtatccaagcttccagcacaccttcatttaattgaaaccgttaaaaaggcagcagaacctgtcacgctgctctttacaggcccgctcacagaccttgctcgggctttagaagaggatccttccatctctaataaaattgaaaaattggtatggatgggcggtacgtttcttgaaaagggaaatgtggaggaacccgagcatgatgggacagcagaatggaatgcattttgggacccttatgctgtcagcaccgtcttcaaggaacgctttcctattgagatggtcgcacttgaaagcacgaatcaagtgccgcttacacttgatgtgcgtcagcgctgggcttcccttcgttctcacattggaattgattttattgggcagtgctatgccttttgtccaccactcattcatcatgaaacgaattcgacgtattacttatgggacgtactcaccacgatgacgcttgcttcttcatcatttacccattcaaaagaagtgaacgcaatcgtttataccgacacgccaaagcaaggacgtaccgaagaacattcagatggaaagtcaatacaagtcattgaccatgtcgatcgtgatgcctttttccatgcatttgaagagctcatgagaaaagctgtttgtcagatttcaacataaaaaaagccccgccaataaacggggctttcaaatgagtgagaaagggttgaaatgatctttatttcagccctttggcttcctcttattcttcttcagcgtactttttcttacgtctgaacttgcttaaaatttcatacacaattgggacgatgaccaatgtgagaagtgtagaacttgttaaaccgccaatgacggtgacgccaagtccttttgatacgatctggcttccgccttcaaatcctaatgcgagtggcagcagtgcaccaatcgttgcgagtgccgtcattaagattggacgtaatcttattgttcctgcttcaagtaaagcttctcttgttgaaagaccttctttttctttatgaatcactcggtcaatcaagacgatcgcatttgttacaacaattccgatcagcatgagcagtccaatcatggcgtttaagctaatggtttcctttgctaaaaacaatccaacgagcgcgccaataattgtaaatggaagtgagaatagaatcgcaaatggtgcaagacctccgccaaatgtgatgacgagaacgaggtacacaatggcaatcgctgcaagcattgcgagaccaagctgtgtaaaggattcctcaatatccgcacttacgccgcctgtgtcaatcgttacgccagatttcacatcaagcttgtcgactttcttctgaacatcctgcgttacacttgagacgttgtctgttgtcatgtcaccagacacttctgcgtagattttcccatcacgttttgtcactgtatttgctgtcgtaccgtcttttacttttacgacatcaccaattcgaacttcttgtcctgtaggtgttgtgatttttttattttctacatcttttatgctcttatattcgtctttttcggtttgaagcttcacatcaagttctttgccgtcttctgtgactttcgttagtgttgtttcactattttgaggggcaatcgcttgagcgatttgtgaagcagttagacctagcttcgccagtttttcttgatctgcattaaacgtatattcgtcgtatttctcagataagcttgtgctgacattttttaagtttttctcatcttttaagatgttctcgacatcttttactgtgccttcaatatcgcttactttgtcgccgtagacatagtacgttacggtattgcttgcgccagcagacgagaagtcttgtgatttccattcccctttagacgttttgtcttgcagggctttcgtcactttatctttttctttatcaaagtttggcgtgtcatcgtcatattgtacgaagaataacgcaccgttagagttgccccctacacttgctgtcataggatttgaagaacctagtgaatattgaacagtattgacatggtcacgcttgatcaaatattcttctgcttttttcgtttcatcaattgcttgttctctcgtttgtcccggctcaggagtatatgtcaccatcgccgtcttttctacttcctgtggtaagaagctgacaccgacaagtggtgctaagaataagcttccgacaagcataagaatcgcaattcctgatgtaatccatttatggttcagtgtccaattgagtacacgtctataaccgccggcaagcttacttggtttatgctcttttacttttttcgctgtgccatacaggttctttttaaatagactgtgtgccatcattggaacaatcgtaatagcgacaagcagtgacgccattaaagcaaacacaatggttaatgcaaatgggatgaatagttcaccaatcattccgcccactaatgctaacggtaagaatactgcaatagtcacaatcgtcgaagacattatcgggataaacatttcttttgtggcttctctgacgagtgtcttgccttttaacggttcatcctttaacgccattcgtcgatagatattttctatgaccacaatcgagtcatcgaccacacgcccaatggcgacggtcatggcaccaagtgtcatgatatttaatgtgatatccagctgatttaataataaaacagcaatcaacagggataacggaatggagatgaccgaaattaatgttgatttgatatctcgaaggaacaacataatgataatgatcgcaaagattgctccgatgatcgccttgttcagcattgtgctgacagattctttaatcggctctgcttgatcatatgtcgtgctgactttgattcctttattgtcttttttgaatttctcaagctctttcgtcacttcttctgccacactcacagtgttggcatcagaacctttgacaatttgcagaccgatgctgtcttttccattcgttcttgaaatcgattctgcatcttttactactttaatatccgcaatttcagaaagcttgatcgttggcagttctacagattgactgcttgctgcacctccaccagtttgctgctgagctgctgcctgttgctgacttgcatttccagcctgctgctccgaaccttgcgcacctgggttttcagcgccgctagatggtgctccagctccagcgcttcccgcaccgccgcttgcacttggtgtgacagggattcgcatgtttttcaaatctttgacgcttaaaatattgccgtccacgacaactgatttttgcttgttaccaaacgtgtatagacctaatggtacattgacatcagagcctttgatcatgttttgaacggtttcttcatctaaaccgtattctttcaatttcttttgtttaaaagaaaattctacttctttgatttgctgtcctgaagcttcgacagaagagacaccgtctaatccttcaatggaaggaacaaggtcgtcttctactttctgtgtaaggtcttctaatgattctttatcaccagagacactgatcgctaagattggaattgcgttaatgctaaagcgtgcgatttttggtttttctgcattttccggaaaattgatattgctaatcgcatcttcaatttccttctttgcttcatccatgtctttcttgtagtcgtactcgatttgaatagatgaggcattttcaaatgaattggatgtgacaacattgactccgttgaggttttgaatagacttctcaatcgggtcggtcaccttatctgatacttcgtccggcgttgcgccaggatacgttgtagaaaccgtaatgactggagtgttgatattcgggattgattcttgtttcatattcaatccggcatatagaccagcaactgttacgataatcgtcatgagccatacagcgaacttattctttaatacaaaattgatgatcgaattcattatgtcctccattttcctttatgtattgactgactggtcattctatatcataataaacggtgatatacaatgccgtcaaccatttcacttgcgtttgacgtaacattctaaagctgaaggggccttatttcatgaacgaaaaaaaagaaaaaatcattaaagcaagcatccagttgtttgcgaaaaagggtttttcttctacgaccattcaggaaattgcagatgagtgcggaatatcaaaaggcgcattttatttacatttcaaatcaaaagaacagcttttcaatcgcgcctttgaatattatatcgacacgtccatgcaaagtattgaaacgattcgaaaagagaatcagcatctcgcgccgagagagatcttccagaagcaaatcgctgaacagtttcaacattttgctgagaacaaggattttatcattttgatcctcagcgagaacattattccagaaaaccagcaaattaaaaagtattcaaaaactgtgaaaaagcaaatgaatgaggaaatccaaatttccatcttgaccacttatggacaggagatcgaaccatatataactgacctgtcagtcatgattcaaggaatcatccaatcgtatgtgcaggtgctgcttttacaagatcagctgcaattatcatttgatgagctctcttcctttatactcgaacggtttgatgatttggttcaaggcatgcttcgttctcagacgaaaccgatcttaaagccaaccatttgggacgatgaagcgccgagtgctgcttcccttcaagaggagcttcgtttgttaaagcttgagcatttactttctgatgatacccttgtatccattgaagtcattgaggaagaactggcgaaagctgagcctcgtaagccagtcattcaagggatgctgacgaatttagaaaagtgtgaggaccctgctgtcataagagtagtcgaacaattgaagctgtttctttcataactttacgcgctgtttttccgattcgttcacctttatcccccttcgaatgtgcactttcgcttacgcttcattataagaaaagaatccccgaattgatatacggcggtggtctgaatctatgataagaccctgtcagttcaaataaaaaaaccgcctcttctcatgaggcggttttttgctatttagcgttttttgatttcttctaggagaatcttgttgaccatcggcgggtttgcttgtcccttcgatgctttcatgatttgtccgactaagaaaccaatcgcgcggtcttttccatttttaaagtcttcgatggattgcgggttgttatcaagtgcttctgtgacaagtttgagcagggcaccttcgtcagaaatttggacaagtcctttttctttgacgattgtttctgcgtctcccccattttcaatcagctctttgaatacctttttggcaatcttagaagaaatcgttcctttttcgatgagcttaatcatgccagccaggccttgcggcgttagctttgtatcttccagctctttttgagctgagtttaagtaggcagatacttcacccatcagccagtttgaagcttgcttcgcttctgcaccttctgaaatggttgcttcaaagaaatcagacatttcttttgtcagcgtcagcaccatcgcatcatacgcaggaagccctagatcatcgatgtagcgtttgcggcgctcatctggaagctctgggatcgatgctcttacgcgttctttccactcgtcatcaatgtacagctccactaaatctggttctgggaagtagcggtaatcgtcagaaccctctttgacacgcatgaggatcgtctttttagacgcttcatcatagcggcgagtttcttgttcgatcaagccgccagaaagcaatacttgctcttggcgtttctcttcgaattcaagacctttttggacgaaagcaaatgagttcaagttcttgagctctgttttcgttccaaactcttcacggccgattggacgaagtgaaatgttggcatcacagcgaagcgagccttcttccatcttacagtcagatacgcctgtatattgaataatggattttagtttttctaagtaagcatacgcttcttctggtgtgcgaatgtctggctcagatacgatttcaacaagcggtgtgccttgacggttgaaatcgacaagtgaatatccgtcgcctgtatgcgtcagtttacctgcatcctcttccaaatggagacgcgtaataccgattcgtttcgttttgccttctacttcaatttcaatccagccgttttcaccgatcggtttatcaaattgagaaatttgatacgcctttgggttatcaggatagaagtagtttttacggtcaaattttgtatctgttgcgatctcgcagtttagcgccattgctgctttcattgcaaagttcaccgcttctttgttcaatacaggcagtacaccaggatatccaaggtcgatgacacttgtttgcgtgttggcagctgcaccaaaaggtgtcggcgaactggagaaaatttttgattgtgtttttagctcaacgtggacttcaagtccaattaccgtttcaaagttcattctgattcaccccttacagttcaggttttgctttatgatgatctgttgcttgctcgaaagcgtgagccacgcggtaaaccgttccttcatcaaagtgcttgccaatgatttgcagtcctaacggaagaccgttagcaaatccacaaggcacactgattcctggaacgcctgcaaggttcacagggatcgttaaaatatcgttcgcatacatcgtcagtggatcgcttgtcttttcaccaatcttaaatgcaggagttggtgttgttggtcctacaatgacatcatacttttcaaaaacatcttcgaagtcttttttgatcaatgtacggactttttgcgcctttttatagtatgcatcataatatcctgagctgagagcgaatgtgccaagcatgatgcggcgtttcacttcgtttccaaagccttcagaacgagtatttttatataaatcaattaggttttctgcattatctgtacggtagccataacggatgccgtcaaaacgcgcaaggtttgcagatgcttctgaagaagacagtaagtagtaagtcgcaagcgcatatttagaatgcggaagagacacttcttcccatgttgcaccaagtccttctaatacttttaatgcttgaagaacagactcttttgcttcctcgccaacaccttctccaaggtattcttttggcacagcaattttcatgcctttgatgtctccagttaatgaagaaagaaaatctgggacgtcgacatttgcactcgttgcgtccatttgatcgaccccagcaatcgcttgaagaacatatgcgttgtcctctacgttacgcgttatcggcccgatttgatctaatgaagaagcaaatgcgattaagccgtatctagatacacggccatacgtcggtttcagacccacaacgccgcagaatgatgccggctggcgaatcgaaccgcccgtatctgatccaagtgaaaatggtacttcacctgctgcaacagaagctgctgagccaccacttgatccacctggaacagtgtttaaattccaagggtttttcgttgctttgtagcctgagttctctgtagaagatcccattgcaaattcgtccatatttaatttaccgattgtaactgcttccgcatctcttagacgattgacaaccgttgcatcataaatagggtcaaagttttgcaggattttactagatgctgttgtacgtaaatcctttgtgacgatgttatctttcacaccgattggcataccgaacaatagaccaagctcgtccttttcaccaactgcctcgtccaattcctttgcatacgcacgagctttctcttcgtccagtgcaaggaatgcttgtactttcccgtctacttcattgattcgtttataagactcgtccactaaatcagaaacagacagttcctttttatgtaaaagctcttttaattcagaaattttgtgatcaaacagtgacatgcctcaggcctcctttagtccaaaattgatggcacacgaatatagccgtctttatgatcaggcgcgtttttgataactgcctcaatggaaagacctttattcggaacatcttctctcatgacgtttttcatttttaatacgtgtgttgttggttcaacgttttccgtatctacctcgtttaactgctctgcaaatgaaatgatgctatcaagctgttcagtaaacatctcagcttcttcttctgtaattgcaagccgtgccaaatgcgccacgtgctttacttcttctattgaaattctagacatgcaggttcacctccaaaaatgatacgtgttcgtggtcatgatcataagtcatatacactttatcatatcaaattttactgttctaaagcaactttacacaggcttgagatggtagccattcaccccaaaccagaaagtatgaaaataatttgtatcagaggttgaacatttatcagaaaattttttcttttaaatgtttttggtagcgcttacatatagattctcatcaatcatttacgcttttttttatgtaagaaagaggtttaagaaggttgatcagcagggaatactctgttaggttaagtaaccatagcagtgagcagacaaacgaattgtatgttcttgtatattttgaatgaggtgatgtcaaattaatacgaaaaaggtgatatggaaacatgagtattgaaattggaatttctctatctatttattttattggaatgctggccattggctggtatgcatttagaaaaacaaatgacttgaatgattatatgttgggcggacgcgggctgggtccttacgtgacagctctatctgctggtgcttcagatatgagcggctggatgctcatgggacttccaggcgcgatgtatacaacagggctttcgtcaggatggcttgctgttggtttgattagcggggcttacttgaattatctatttttagctcctcgcttacgatcgtatactgaggttgctgatgatgcgatcaccattccagacttttttgacaaacgatttagagattcttctactttattaaaagctgtctcggctgtcattattatgattttctttacactgtacacctcatcaggtatggtatctggcggtcgtttattcgaatctgcgtttggtgccaattatatgtttggtttaattttaacctctagtatcgtgatcttatacactttattcggcggctttttggcagttagcttaactgattttgttcaaggagccattatgtttttagcattagtgctcgtgccgatcgttgcctttactcaattaggtggcccaattgccacgtatcaagatatccaacaaattgatccaaaattgcttgatatattcagaggaacgagcgtcattggcattatttccttcttagcatgggggcttggttactttggacagccgcacattattgttcgattcatggccattacgactgtaaaagatttaaaaccagcacgtcgtatcggtatgagctggatgattgtgtctgttattggttcactgtctgttggattagtcggtgtcgcttatgtacatgagactagtaccactttagcagacccagaaaccatttttattgtgttttctaaggtgttattccatccgtatattactggatttttactctctgctattttagctgcgattatgagttcaatttcttcacagctgcttgtgactgcaagtgcaatgacagaggatttataccggactttctttagaagaaaagcgtcagacaaagaactagtaatgattggacgtatgtctgtattggtcgttgccattatcgcgctttgtctttcacttaatccaagtgataccattcttgaccttgttggttatgcttgggcaggttttggatcttcatttggtccagtcatccttctatgcctatattggaagcgaatgaaccatcacggtgcactagcaggaatggttgttggggcagttgtagtcttaacatggatttcaaccggcttgaataatacaactggcttgtacgaaatggttccaggatttattttaagtggtttgactgccatcattgtcagcctcttgaccaacaaaccatctaaagcttctaaaaagctgtttaccaaaatggaaaatcatcttgaagaagaaacaaaataaagaacatgaggggtcatctgccttaagcggatgactctcttttttaaataaaatgcttttctttctcccatttctgaataaaatagaagttgtgcagccatatgggctgtgagaagatcatatacatgatgtgaaacgtacatgaagtgaaggagcgatacgcatgttttggacgattgaatgggatacagtcttaaagttagccgtggccaccttaatcggtttgattattgggctcgaacgagagctgaagaaaaagccgctcggcttaaaaacatgtattgtcattgctgtcagctcctgcgtgttaaccatcatcagcattgatgcagcctacaatttccctcgagtctctaggcttcaaatggacccactcaggttaccggcgcaaattatatctggtgttggttttattggagcaggtgtgattctgcgaaaaagcaatgatgtcatctcaggtcttacgacttctgcgatgatctggggagcagcaggacttggggttgcaacaggtgcaggattttataaagaagccttcctcagtcttttctttattctggttagtgtcgaatttctaccgtggctcttccagcggatcggaccgattcgcttacaggaaaaagaaatacgcatcagaatgtctctttctgatcgaaaccgtatgacggatattttaaaagaaatgaaagccctcaatattcgcattcattctgttcgtattgatgatttaacagaaaagaactatccgattatggaagtacgtgtacgcgtgcataaagatcgctatacaactgatgtgtattttgatattaaagatctagaaggcgtcgttggcgtcaagtgtgatacggtataaaaggtgatgagtcaaaagtctcatcacctttttttatgggaaaaggggttgaaccatcaccttcattcaaataaaatacaaattatgaaataaatgataaaaggggatttttcatgggctctatgaatcgtaaaaaacgtatttatcttatgagtggaattctagtagtactcgtattcgctgctttattgacctcacattatgtcactcccgtatcaacaaatgcagcagacaagaaacaaacgaaaacaccaaaaaatattatttttatcgttggcgatggaatggggatgcccgtgatcaaagcctaccgcacattcaagcaggaaaagcttggttctccaaaagcacaaaccgtctgggacccgcatttagtcgggatgcagaccacacacccagatgatcctcgagataatattaccgactcagctgccgcagccacggccatggcgactggaaaaaagacatacaatgatgccatcgccgtcaaccaagataaagaacctcttagaagtgtcgttgaagcagcaaaggaagcacaaatgaaaacagcctttgttgtctcatctgacatcaccgatgcgacacctgccgcttttggcacacataacgtctcccgaaaaaacaaagaacaaattgcagaccacttttttgatgagaaaataggcggagagcacaaagttgatatccttctaggtggcggaatgcaatattttgaccgaaaagaccgtgatcttgtgaaagaatttaagaagagcggatattccattctaagatcaaaagatgatttaacttcccaatcatcttcgaaaatgctcggcttattccaagaggacgagctggatcgagccatcgatcgtccaaagcatgtgcctactttaaaagacatgacactggcagcattgacccaattaaatcaagacaattcgcatgggtttttcatgctgcttgaaggcagtaccattgattctgctggacatgaaaatgatgtggtcggcgccatgagtgagatggaggattttgagaaagcagtccaagcggctcttcaattcgctaaaaaggatcaagaaaccctcgtcgtcatcacagcagatcatgcgactggcggcttttcgtttggtgcagatggcatgacaagtgaaaccggctataaatgggacccagcacccattctagctgctaagaaaacacctgtgtatatgacaaagaaaatcgcagacggccaatcggtacgtgatgtccttcacaccaatattgatttctcactcacaaaaaaggaaatctcacaggtggaaaaagcggcacaatcagggaaggccagtacgattcaactcagcattcaacacatctttgatcaacgttctttctcaggctggacaacctttgctcatacaggtgaggatgtccctgtctatgcatatggacctgggaaagcagcatttcaaggctggatcgataatacaaagcaaggaaagaatctgtttcacatcattgaatcaccgtccacctatcgcccataaaaaaacaatccccgccttatcacagaggcggggattttgatgttaagattgacttagctttgtaaagtcaaacgttgtaatcggcgctgcttgctcaatgtcagagcggaagctagcgagcatggccttctcttcttctccgatggtagccaaatcaaatgcttgatgcagcaagccatagatcagcacgtgacgtaagcgaaggaagtcaggaatgtaggcaagccactcatccccaagctcattctcttcacgatagcctttaaggaactgcttcataaagtttcctgcaaaagctgctttgtcttcgtatggaatgactgggtaccacaacacattgtatagcaaaatgctaatatcattcataaaccaattgtacccgatatcatcgaaatcaaaggtcgtaattttgccttgatcccagtggaagtttccgtgatgaagatccgcatgaaccaatccgtacgtatcctgatttttcggaagctttgacagcttttccatcaaccgatccgcttgttcgaacacaagcgtctgatcggctggtacatacttacgtaatttaagctgctcctcttcatcccactcttgtcttttatatcgcgggtttgacagctgatagctttttgtcagtttatgcatgcggcctgtgtactgtccaagcgcataaaataattcatcattccagtctgcctcttcgactttatggcctggtgctttttcatagactcgcagcaaaaatgaaccgccttgcccatcgtctacttgctcgatatcacggccatttaatgaagcaattggttttgcaaccgaaagtccgcccttcgctaagtgatggagccattccatttcacctaaaatataatcaggtgatctgcggatggtatgggtaatttttaaaatgaaagactctccgtcttttttaagttcatacacatagttttctgcatctgcgataaagtggatatcacttcgctggactccgtataaatgagtggcctcatctaaaatttttgattcttcatatatggcttttacatctttatgcatgctgattctccctcttcatatattttgctaattctcgaatggtgtgtttttcagcaaaattcaaatcatcaacataccaacccttcttttcaatctctacttccattttgacagcaagtaaagaatttcctcccaaatcgaaaaagtcgttgtcaattcctactttttccacatgaagaatgtcacaccaaatttcaagaagcaatgcctcgcgttcattagttggctgtgcgtaaagtccttgatcctgcgttagttctgtctttaataatgatcgaagaccttcttgatcatgtaccttaagggcttttacataaccgctgtgcagcgtttgatctgtttgaaccgtttcccatgtgtaaccttcagaagctgaatgacttactgtctccaccctttgaccctctatttcttcagctgggtgctgacgaggtgacaggtggtcaacaatctgaatgtgatcacttagtgaaccgatttcttccacttgtatacggtatgtttgctgctcctcaatctcctgcatcttgttttctttcataaatgacttgaacagctcattacgtccagtcgatgcaaatgtgaattcaatagcagaaatctggtgctgacggctatactcagcgagccatgtcagacatttttgctcaatccctttccctagcgcacggcagcttagcatccatgcatcgatgatcaaggtgtcgcctgcatgatgagccaagatcgcccctacaattccttcatgactaaagcgatccgctgactcaataatccagccctgaacacgctcattttccaatcgctctctcagctgctgttcatcaaagcgctgatcatttaagcggaattggttaatgcggctgctcatttgcgccacgcgggcaaggtgcttttcttcccactctgttacactcatgttcaaattcaaatcttgtaaaaattgctccatagacggcgattctgcttgctctttttgacgagctttttcagccttgtagctcgttgttcgccctctatcttcatctgtaatatcatagcggtcgaatgcccaagcatgctgggcgaataatggaatcgctttttcattggcaggtaacagcagggtcatcacttcaggcagctcttcattcatacgcaagcactgagcaggatcatcgtctaagaaaataaactgagataatgaaagattcagtgaatctgccatctctttgagatgtgccggtttactttcccaattgatccgccagtcgacaatatcgtctttttgcaagatcatatctgggtggttttcaaacacgcgccacacatcttcttcattattcctgctgcttaagacaagcaagagaccttctttttgcttttgttttaaaaagcgctgaagcatttgatgttctggcgtaatatcgatgccttctataccgtcttctgaaacgacacctctccaaagcgtgtgatcacaatcaatggctgctaccttaaatggtgcaccttgccatgcaatgaactcacgtgcgacttttgttccgatggctccacaaaagacttctgtgaatgggagatgtgcggcttgctctccttttgcatcaaagatgtcattcatctgatattgctgcgcaagctgacggcaatcaatcaattgaacaccgtctatctcagataattgagtaatccactcttgttccacatcttgcagcgtgtctttaagagcagcacttatcggcagaatcccaacaaaatataggttatgtttcgtttttgatttcagaacgcttgcaagttcttcagcatgctctgcagcctgttttttcttttcttccagtgaaagatgagctgggcctgtaatatcctctaaacgaatgagcagaaggttcgcaccgtttttcttctgtgagataaggctgcgctcatttaataattcctgatatacctgcccatacggtgcaaattgaacatccagctgcacgtcaaactgtttggtccagtactgaatgtaaggtgcgatcggatctgctgtaaatgtcgagctgaccgttagtacgagcggtgctttttcctctgcacgctcccttttctcctttgctgcctgttcttcttcctgtgaaagaacagcgaaatccttgagcaattgatcaggtgtttgaacagcctgttcgaccaagtgctcgaagtgcttgacgaacgcttgcattgtctcatgtttaaacagtgcaagattgtattgaaggacgcactttaactcacctgttacttctctaacaacatccattttcatatcgagtttggaaattccctttgcaaactcatgtgtttcaaatgttagtccatcggcttcgattttaatattcggatcgtactcattatggtaaatgagcattgtatcaaaaaatggattgcgatgcggtcttgtttttggattcagatgctcgaccatttgatcaaatgggtactcttgatggtcatacgcatccagcagcacttgctttgtctgcgccagttgctctgtaaaggttgcgtcttgtaccatgtctagtttaataggcaggaagtttgtgaacatgccaattgtatgctcaatatctgcatgacgccgtccagccacaagtgacccgacaatcagctcctcttgatctgcataacgtgagagcagcagtccatagagctggaacaagatgacgttatttgtcagctgatactgttcagcaagctgttcaattttctccacgatgtgcggttcaatgttgaatttgatcgctcttcctaagaaggattgttccttccgttcaaaatcatatggcattgtcaaagttggcacatttgagccaatttgctgcttccaataatcctgctgcttttggaacatctcgctgcggaaatatttgtcttgccattctgcataatctttatattgaacagtgagttccggcaaggtttcccctcgatagagctcagtaaattctttaataaagatgttcatgctcgctccatccgccacaatattatgcatatcgactaataagaggtgatcatgtgctgctattttcacaaaacgcacacggatcaatggtgcagcctttaagtcaaatggacgaatgaattcatcgatttgtgcttctaatccttcttcatcagcctctgtcaattcaacagcaaactggaagtcatcatggacccgctgaaccggttcaccatcttttaattcaaaggtcgttcgcaaggtttcatgacgatcaattaattgcttgaaggtctgctcaaagcgctcgacgtcaatttcccctttacatcttagtgccatcggcatgttgtatgaggtcacttgaccaatacgctgatgaatgaggaatgtccgtctttgagcagcagataatggatacgtgtctttcttttcgactggttcaatcttgaaatattgatgcttctcagccttctcgatgaatgcttggagcttttcaatcgtcggattgttaaacatatctgtgagcgttagctctacaccaaactctttgtgaatttgagaaatgagaccggtggcatttaacgaatgtcccccaagctcaaagaaatggtcgtctctttccaccttttcaattcctaaaatgtctttccacatccgctgtaacgttgcctcaatgtcattcgatgcggcggcatggacttgattgttttcttctatttcctgtgtcttgttttcctttggcaccaccatttgcacacctaaagatgaagataatgcagctgtatctaccttttcaatccaatatcgttgtcgttcaaacggataggttggcaaggatactttttgatttgatgtctgatttcgcaatcttgtccagtcaaccggcaccccttgaagccagatgtcacccaatcttcccagcaggtagcggtcgtcggctacctcttcttttggatgacgcattaatggaatcggctgctgatgatgttcctttgaagcttggcgaataaaggcacttaacgtattccctggcccgacttcaacgaaaataggatcaagctccgttaataatgtctccgctccatcacggaaacgaactgcttgtcgcaaatgatcagcccaatatgccgggtcttgcactgcttcatggtcaatccacgaacctgtgacgttagaaatatacgggatagacggcgcattcaattgatactcggcgaccttttctttaaatgatggcaagatgtcatccatcattttagaatggaaagcatgagaggtgtgaagctttctacacccatgttcagcagcctccagcttctcagcaagtgcatcaatggctgcggtctcacctgacactacgcacaattcaggaccatttactgctgcaagtgaaagttcatctgttaaatatgacagcacgttctgttcactcaaaggaacgctcagcatagagccttttggaagctggctaatgagctgtccgcgataagccacaagatctacggcatcttcaacagatagtaaaccagataccgcagcagccgtgtattctccaatactgtggccgatcagtgcctgcggtttgacgccaaaatgaatcagcaatttagccaaagcatattccacactaaacagaagcggctgcgtgtattctgtttggttgatcagctgacgatcatcactttcttctgttgaaaacaaaagacgaaatgggtcaactgagacatgctgtttgaattgattcaagcattgatccagcgcttccttaaagactggatatttgtcataaagctgacgccccatgtctacatactgagatccttggcctgggaaaagaaagacgactggacggctcgatgtttgggagctggccgtcttgaccacctcttttgacctttgactgagcgcctgtagcatgtcagccgtgttacttccaagaatgacacgtttatgcgggaaatgatggcgccctgtttgcagcgtataggcaacgtcacttagacggacttgctgctgatgctggagtaagtagtccgcaagacgatccgtcattttttcaagagctgctggtgttttggcagataataaaagaagttcactctcctcagggctatctgttgctacacgtgcagcaggtgcttcttctaaaatgacatgagcatttgttccacctatcccaaatgagcttacacctgcccggcgaggagattcttgcgtgctccatggcgtcaaatctgtgtttacaacaaaaggcgaatcggcaaactcaattttttcatttggtgtttcaaaatgaatggtcggcggaatcacttgatgctttaagcttaaaacggttttaataaagcccgcgacacctgatgcatcattcaaatgaccaacattcgatttgacagaaccaatccggcaaaagccttttttatctgtatcaaatgcttgcttgagcgcttcaatttcgatcggatctccgagggttgtcccggttccatgtgcttcaatgtacgaaatggtttcaggttccacctcagccattcgaagtgctgtcttaatcgctgaaacttgacctttcgtacttggtgctgtatatcctacttttctatttccgtcattattaatagatgatcctttaatgacagcataaatgtgatcgccgtcttcaatggcatcctctaaattttttaaaataacagcacctgcaccatcaccaaaaacggttccatcggctttgttatcaaaaacgcggcaatgtccgtcagatgaatggatcatgccttcttgatacagatagcccgatttttgcggcaggcgaatggacacgccgcctgcaactgccatatgacagtcgccgcttaataaagcctgaacggctaaatgaatcgacaccatcgaggtcgagcaggcggtttgcaccaccatactcggtcccttcagatttaatttatatgaaatcatcgtcgctaaataatcacgcatattcagaacggcagcttccagtgttttcgaatcttcaccttgtgccgccccttgaagtgctctcatgacccattctgtattgatccctgcacctgtataaagaccgatttgccctttatattcaaacggatcgtacccagcgtcttcaagcgccgtccaaacacattcatgaaacagtctaaactgcgggtccatcatagccgcttcctttggtgtatagtcaaagaaatctgcatcaaataaatccacatcatctagcattccttttgctttaacaaaacgggggttttttaataaagcttcatctgtaccttcacgccgtaattcttcctctgtaaaaaaagaaattgtttcttttccctttttcagattctcccagtactcatctacatttttggcccctggaaaacgacctgcaagaccgataacagcaatttctgcgccatgataatgattcgttgtatcattcattctcgattccgcctctcaatcttttattccgttgctgtttaaaacgagctcttcgatcacctgaagtgacgacggctagttcttcttccatcgcttcttccttcgagtcctcagaaggctggatatatttcgcaagttctgcaacagaagggtacgtaaacaaggtcacaaccgcttcatttgtttgaagtgcttgatttaaccgattggtgacttgaacaatatccagcgagcttgcgccgagatcaaagaaattgtcgtgaatgcccacttgttccatgcccataaaatcctgccatacttgacagatcgctttttcagtttcatttcgaggcgccacatatggattgcccagctctggtctttcgtgcttagacacttcatatgaatcctcatctggtgcggtcttagactctagtgacagccattgatctatccgttcatcaagatttcctgtggacacgagcatgtgtcgattctgccggttagacagaacatactggaacagctcagcaccctcttctggtaaaatcgcaagctcattgatcgattcaccaattgtggattctagctcaccccagaaattccatgcatcccagttcacacacatccacggggtttgactatgttgattaagtctagctgcaaatgcatccatatataagttagccgctgagtaagcagagaatcctaagcccccaagcaatgcactaatggaagaaaagagaagacaaaagtctgcttgttcttgttccagcagctgctctagcacatccagccctttcacctttgattggaattgatcctctccctgcgccagtgtagaagggatatctttgatggcacggaaggatgtacttcctggtaatcctgctgcatggaatacaccatgaacgccgccatgctttttgcgaatggcatcaaatacacgtttcatctgatcaagatctcctgcattcgcctgcaccgcttctactgttgcccctaatcgttcgagctcaagcaccttttcaattctcgtgcgctgcgcttcatcggcatttgcttgttgaacatatgacgcccattcatttcttggcggcaatgccgttcttccagttaaataaagatgtacatttccttccttcgccagcatctttgacagaacaaatccgataccacctaaaccccctgtaatcagatacacaccatttggcctgatcatcttcggaagtccatcttctttttgtagcggcaaatgcttgtagctctctacccagcgctttcgatgacgatacgccacaagctggtcctttccaggctgcatgatttcctgcaaaataagatcgacaaggacttgttccttccaagacatgacttctggcacgtcttccacatcgatattccagcacttaatatgatggtattcctgtgaaatgactttacatggtccaagcattgcacttttctctgcacatatcgtctcattgcctgtgactggctgaattccgctagtgatcgtaaacagacggcattctcgaatatttttttgggcagcaatcgcttgagataagaaaattaaactgtaatagcctttttcaatgtgcgcctgaaaagcagcttgacgattcgagttgtcatcttctttcgcagcttcccataaatgcagaatccgctggatattgatgcctctattagacaatgaatctagcatatttcggtagtgctggccttctgccggattgatcgtaaacgaatcatcttgcacttgataagcttcaccctttgtgactgaaatgaccttgatccctttttgcttaaatgaatgggtaaacagttcatgaaaagcatcctgttccctgaaaatgagccacgtttgttcttctgtttctttttcgaaaactggttttagcggctgctgttcccatgaaggcaggtagaaccattcttccatctctttcttcttcgtttccttaggggcggatagctgcggagacgctgactttcctgcttcaatccaatatcgtttccgctcaaatggataggtcggcagcgatacgagctgacgttcctcttgagttggatgttgctgcgctttgacctcgtagccccctgcccatagctctcctattctctttaagaaatatgcatggtcatccgcttgttctctcgtatgcctcaccatattcaggacatcatgatgtgactctttgttttcatgacgtttcgctaatgccgtcaagctgtttccaggtccaacttcaatgagtgctcgtacttcatcggttaacagctgagatagaccttcatgaaaacgaacggttccacgcaggtggttcgtccaataagatgctgtcatcacatcttcacttgtcgcccatgtgcctgtgacattcgatataaacggaataaccggctcttgcaattctactttttctacgatttgttgaaacgcctcaagcatcggctccatcatgtaggaatgaaaggcatgagaagtatggagctgtcttgtgataattcctttgtcttgcagtttcttttcaaatgcagcgatatgctcttctcttccagaaacgacacaaaggtcttttgcattgacagcagcaacagaaagcgattcatcgatcatcgagacgagttccgcctctggtaattgcacactaagcatcgcgcctttttccatgtcttgcattaatcttcctcttgccatcacgagtgttaatgcagactcgagagaaaagacccctgacaaacaagcggcaacgtattcgccgatactgtgtccaatcattgattctggctcaacaccgctatgttgaagcaatttggctaatgcatactcaaatataaagaggagcggctgggcatttgacgtttttgtgatgtcttcgttcgtttcatcctcggaaaaaacaatgccctttaaatccacttgctccgtttccattacatatttaaagcatctatctacttcccatttgaacactggctctgcatcatataacccgcgcatcataccagcatactgagcgccttgacctgaaaacataaaggttgctttgcgccatttttggcttcggaacacactcgtttcaagctgtttctgctgcatccattcatcagcagacgcgagtacgatcgcttttcggtatggaaactgctttctgccataccgcaatgtataagcaatatcttcaagcggaacttgaggatgctggatcacatactgctttaattgctctgtcattttcgctaaagcagtatctgttttagcagataagacgagtagctgcttttgggtagaagctggtttttgcttcgcctgtatgccctcttctatgatcatatgagcgttcgttccgccgataccaaaagagctgactcccgctcttctcggaccatctgcttccttccaatacaacgccttttgattcacataaaacggtgtatctttgaaaggaatttcctgattgggtgattcataatgaatggttggcgggatcgttttatgctggagagccaaaatggctttaaacagacctgcaatccctgccgcactatttaagtgtccgacattacttttcacagaaccgatcggaatcgtcagcggatctgtccctttgaacacttggctaagagcggatacctcaattggatctcccatttttgtccccgtaccgtgagcttctatataaccgatagacgcgggatcgatacctgatttttcatacgtttcttttaaaacctctgcttgtccttccacactcggagcggtaaaaccagcttttcggctgccatcattgttcacaccaacccctttgatgaccgcatgaatcgggttgccgtctctcatcgcatcttcataacgttttagtagaacaattcctgctccatctccgaaaatggttccgctcgcctcttggtcaaacggacggcaatgtccatcttttgattgaatcatcccatcttgatagatgtagccgatattttctggagaactgaccgtcacaccgccagccagtgcggcatcacattcttgattcaataatgcttgacaggccatgcctatgttgacaagtgaggtcgaacaagctgtctgcatggtcacactaggcccgtgcaaattcaatttataagaaagctgcgtactaaaaaactcacgatcatttaacagcatggcgctgaactgctcagttgcttccatttgatgggcaaagcgcgtcagccactcatggtttggactcgttcctgtataaacgccaattttccctgctattcgatcagggtcacagccagcatcctccagcgcttcccaagcacattcatgcaagagcctgaactgcggatccattagctctgcctctctagcagaatagttaaagaagtctgcatcaaagccttcgatctcttgtaaacgaccttttgctccaatgaaattcggatgctggtagacagacgcatccagccctgctttcttgagctcttcttctgtgaaaaagtgaatcatttcctcgccattcacaagacgctgccaaaagtcttctagcgatgaagctcctgggaatcttccagccattccgacaatcgcaatatccgtatgctcttgggacgtgttttttactgggcgagaagcaggcgtttgaacctgttctgactgttcttcaaataaatattcagcaagacttgccactgtcgcaaaccgatacaattgcacagtgtcaatttgcttgtcgacgtgctcagatattttcgctgcaagctgagaaatatcaagggatgtcgcaccaaattcaaaaaatggcgattcatcatccatttgatcaaacccaaaatgagtttgcacaatgtcgtgaatctctttttgtaaagaagcgagtgaagcaaagacacgctgttcattctgcggcttttgcggttcaatggctgccatcgtatttgtttgtgcagagaaatcggttttatgaaatgggtacccaggcagcggaatacgctgcctgttcttctcatctgttaaaggaaaggctaagccgactcctatttcccaaagaacacctgcgatttgaagcatgtctccatcaagtggttcggttgttttttctactcccttttcaaatacaatcccttgtttcattgaaaggtcaatgatcaaagctggtgattcttgctcaatcattggtgattttacaggctgatccatattaagaagaccttttgcagacgatgggtcgaaagtgattagttcctccccggtttgctgcaagtaaacaggctgctttagtgtcctctgaggcagggaagccagcctttgattaaccgtctcggtgtcatgaagatggtacacaatagataccgcatcgtttagctcaaggccgcctgctgcatataaagctgtccagactccgctgccttctccaatccagccatctggttcaattccgattgatcttagcatgttggcaaaagccgatgtcatgatcagcatcgccacttctgattgacggctttgtttaggatggaacagctcatcttttttgataggtacagcgggttggacaaggcttacgattcgatccacttctgttttgaaagaaggatctttctcatacagctcgatgtaatcacgtaaacctgactcatggtaccccttcagcttcatgttgatccgtttataaagatgactttctctgcctgctgtctcttcattcagcaattgcagctccgctaataactcttcccgcgtggaacagacaaacgcttttcgatatttgaaagcctttcttccactttgtaatgtataagctgcttcaccaagtgagagatcaggatgtgaggagacatattcctttaagttttttgtcatgttcttcagatcatgcgttgatctagctgagagcacaattaattctttggacgaggccttgctgtttgtttttctcggctgtgcctcttctaagatgacatgagcatttgctccccctataccaaaggcactgactccagctctccttggcaattgagatgtcttccactcctctttgtctgtcccaacataaaatggggtttgatcaaaagaaatacggtgattcggcttctcaaagtgcggcatcggggcaaattgacgatgatgcagcatcatgactgttttgataaaaccagctacgccgcttgcggcatctaaatgcccaatattggctttgactgatccaattcggcaatagccttgttgatctgtttgaaaagcacgagtaagcgcctcaatctcaatcggatctccaacaggcgtacccgttccatgtgcttcgatataagaaatcgtctctggttctgtctcagccatttctaacgcagattcaataacacttgcctgtccactcacacttggggctgtatagccgactttattacttccatcattgttcgttgcagatccttttacgacagcataaataaaatctccatcttctatcgcatcttttaatcgttttagtgcaacaacgcctgcaccttcaccaaaaacggttccttttgctttttcatcaaacggacggcaatgaccatcaggagaataaatcattccttcttggtattgatagcctgtgatttgcggctgatggagtgtgacacctcctgctaaagcaaggtcacattcaccgccgattaatccttggcaggccatatggatcgcaacaagcgatgtggagcaagccgtttgcaccgatacgcttggaccttttagatttaatttataggcaattcgagaagcaaaggatgggtcattgagatgcatgatttgaaacacatcttcgttctttgcaagtgacgacatatgctgccccatccacgatagattgctagatgccccagcataaagaccaattaaaccttcgtattgctcaggttcatagcctgcatcctcaagcgcatgccatgtgcattcatgcatcaatcgaatttgcgggtccataatcgatgcctctcgcggagagtagccaaaaaagtctgcatcaaatgatgatgcctgttttaaatatggctttgccttgacataatcagaacgttttagcagcgtctcatctacacccgctgcctttaattcttcatcagtgaaaaacgtaacggattctttcccttgcgacacattttcccaaaacgcttgcacattcggtgccccaggaaatgtacctgctaatcctacaactgcaatttcaagtccagattcgctccattgctcttgatcagacatacgctgcatttctcccatctattttcgttttaatctctgtttacggcggtttttcccatctgccatcgcctgtttgcggagattagatgattcagtgacagcttgcttttcttccttcacgccatgtatcttcttcagttctgcagccaatgacgcgatcgttggatgactatacatcatgaccactggaacctctatcccataaattgatttaatatgaccgctcatctgcagcaaatcaagggatgtcgcacccatttcaaagaagttctcattcacatccggttcatgaggaaaaaaggagctgagtgcatcactcaatgagacttctaggcgatcatctatgacctgcgatatttgttgcgacgactctttttcctcctgcataggtgttaagcggtgctttattctctcacccatgtctcgaacagaaacaagaatttgtggatagtctagacgaagcacttcctgaaaggccttgattccttcttctggtgaaattcccgcctgctcctcgagcgccatcatgtcattgactttggccgctaatgctgagtcgtgtgccatgccgactttttcccatcgatcccagtttaatgaaatcactggctttctttcctgtctcttcgcatgagcaaagctgtccataaaagcattggaagccgcataagccacttgtccagccgctccaagaaaagacactagggatgaacaaagtaaaacgaagtcgagcgtttcattcttgagtgcttcatccagcacataggtcccgttgatttttgcctgacacatgcgaatttcatcgtctgctgttcttgcttggatgatcttcccatctgcctctcctgccgcatggatgacaccatgtaaatcgccaaacgttgtatgagccagctggaccgctttctgcacagcgtctttatccgacacatcaccgtgtacagttagtacatcagctcctaactcttcaagagtcatcagctttttcacggtttcagcttctttcccatctgcatcactcagctcatgccatgcagagcgttcacgtatctgtgatcggctgaggaacacaagttttgcttgatacgtttctgctaaatgttgagctagtgtgaagccaatgcctcccataccgccggtcaggaggtaaacaccatgagtcctgaaaggctgcgtggacgattcctctttacttaaaggtgtacttgaagcttttcgaacccacctgctgttcccccgatacgccacaagcgcctcttgatcgtgcattgccacctcatatgaaagaaatagcggccagtccgcctttgtttcctgacataaatcaacgtgctgacacgcaatatgctgatattcttgaggaatggtcagagctagtccagtgcatgttgcttgaagaggattgaccttctccatcccgatgacatcatgcgcttgatttgtcacaagatgaagacggatggttgtgttatgatgctgactgatgagcctgacgagatcgagtacagataagtagtttggctgatcacctgtatcttctgtcagttcatcatgcatccagatgatctcttccggtataaacccagattggtgcagttcagccataacccactctaagtgtgacagcatatgaacgtcagccttcatcaactggtcattttctttgatcgtatgatcactttgacagacgctgacaacttctgcatgccgttctttcaaatagtcgccaatatgaccacttttctcaaaaaccaagatacgcttcccttgatgatgctgctcttttagtacaggtgcagagcgctcccacaccggtatataaaaccagtcttcaaaatcagcggagaatttctcacccttttctgatggcgctatagcggtcatcagctgatctgctttaaactgcggagaggggaatatttgatgctcgaatggatatgttggcagtgacactcgatatggggccttttcttttctgacagcgctccagttcggttccactccaaaactccacagcttccctatagcttttttcatatattcatcatcagcagcttgttcttttgggtgtctcaccaatgaaacagctgctgctttgttcacatcatagtcctcatgtcgtttcacaaattgagtcaacgtatgacctggccccacttcaatgaaaaccacttctccaagtccaagtaacgtctctattccttgactaaataaaacaggctgcctgatatgagatgcccagtaatcaggcgatgatgcttgctcatttgttaaccagttccctgtcacattcgaaagaatcggaatctcgccctgttgataggtgatttccaagagaacgtgcttaaactgtttggacgcttcagccatcatactcgtatgaaaggcgtgagaggttttcaatgtttggacagaagctcctcttttttcagcttgttcgagatagatctgtaatcgttctgaaggaccggaaacaacagataattgcgagctattcaccgcagaaagctcgacaccttcaggaagatcatgttcaatctcttcggcagagagtgacactccggccatttcaccccgaggcattttttgcatcaaactgcctctttttaaaacgatacggattgcatcttcaaggtgaataataccggccacgcaggcagctgttatttctccaatgctatgaccaatgaaataatgcggacgtatgcctagtcccatcagcttcgatgcgagcgcatactcaaaactaaacaagatgatttgtgtatatgatgtttgctgcatgagctgttctgcttttatgaactcttcttcggttgttgggtataacacgttctcgatctcaacacctgataaagataaaatgatggcaaaacatttctgaagcatttgtttaaattcaggatctttctcatataaatctttgcccatattcacatactgagcaccttgtccagaaaacatccagacgactgcaggctgttgaaaggccttttgcggctgtcccgctgactggaatgtgcggtcaggacctgcaagaaaagcttgtcgataaggaaaatgctttctgccctcttgcagtgtaaaggcagcctcggatagtgtgacacgcttttgatcttttaaataagatgtcatttgttcagcagatttttgaaccgcctgcttcgatcttgcagaaatcaccattagttcatgatctctttctactgacggtttgtcggcagcgggtgcctcttccatgatcagatgtacattcgttccaccgactccaaatgaactaactccggcacgcagcggctgctctgttttcgtccatggtacgggtgttgtattgacataaaatggacttgattcaaaatcaattttcggattcggctttttataatgaaggctaggcggcagcatctgatggtacagactaagcgttgtcttgataaaacctgcaacccctgcggctgaatcaagatgaccaatattggttttcacagacccaatcgcacaaaactgttttttatccgtttgaaaggctttctttagtgactcaatttcaaccggatctccaagagttgtacctgtgccatgtgcttcaatataagaaatactctcagcttctacacgactgatgttgagtgcctttttaatcacttcgctttgtccttctatacttggtgctgtgtagccaactttccgcccgccgtcattgttataggctgaacctttaatcacgccatagatatggtccttatcttttagtgcctgctttaatgatttgagcacaacaacgccgcagccctcaccgcctacggtaccttctgcctgttcatcaaaagcccggcagtgcccatctggcgacatgatcatcccctcttgatacatgtatccttttttgtgaggggtcgtaatggtgacgccgcctgcgagagccattttacattctccggtaattaaggcgcgcgccgccatatgaatggcagtcaaagaggaagaacaagctgtatcaacagctacgctcggccccttcaaattcaatttataagatacctttgtgttcatgaaatctttatctgttaactgaacagccgcaaattgttcggaagagtgattcgttctcatcagcatggaagcagcttgccaatataaattagcagaggcggctccaaataaaccaatcggttcctgataggtttcaggattatagcctgcatcttcaagagattcccacgccacctcatgaaacatgcggatctgcgggtccattacttctgcttcacgctgtgaataaccaaagaaatctgcatcaaaatgatcatgctgatcaactgctcctttggcacgtacatattgctcatgatccaatgcttctttctcaacccctgcctcaagcagctcttccttcgaaaagaacgtaatagactctcttccatttgcaaggttgtcccaaaagtgatgaatattctttgctcccggaaaacggcaggccatcccaaccactgcaacctctaatcctgtgaacttactcatctatcatcccgcctaacagttgagcggcactttctaagtcatccgcttcattttctccatcatcttcgatttgtttctcttgccctgatgctttgttttttatttgagcagctatttgtgaaacagttgtaaattggaacagctccatcactgtcagctcctgctgaaattcctctttcactttattggacaactcaacgatattaaaagagttcccgcctaagtcaaaaaacggttcatctatacgaatctgcgaagcagggacttgtaaaatagaggcgaaaatgcgaacaagcttctgctctgtttcattatgtgcttgaatggtcacaggctcttgattgtctgccagctgatcttctggattcggcagtgcttggatatccaatttccctgatagattcaaaggaaattgctctatttggatgacatgtctcggcaccatataacctggtaatctatcacttaaagactgacgaagcgcgcgctgatctatcacttgttttgccatcatgtatgcgcaaatgtattggtcctgatcctgcgtttccttaggaatgacaatgacatcttgaatcaatccttgcatatgcgggtcatcaagaatcgctctgcggatttcctctagctcaattcgatatcccctaattttcacttgaccgtcgtttctctttgcaaattctaataaaccatcaaaccgccatcttgcaaggtctcccgtacggtataacatcccgctgctgagctctggttttttaataaatttctccttgctcagatcagggtgattgatgtacccacgacctacaccatcgcctgttatatataactctccaaaaacgccaatcggaactggctctccttgcgcatcacatatgaaaatatgctcattcggcatcggctgcccaataggaatgacttgctcatcccagtcttggggaatcaaaaaggatgatgactgaaccgtacattcagtcggcccatacgcattaatcatgatcggtttttcacctgatatatgctgtaaaaattgatccatcagctcttttgtgaacacctctccgccaaccagcagcatgttcaacgcaggcaggtcttgtcttgattgcgctgctgctttgttcatcagcttcaagtgggagggggtcacatcagacagctgaatgtgatgttcttggtaaaacgaccataacgcatgcccatccatacggacttcatctttggcaatatgcagcgtatgtccgaggagcaatgctgggaacaatgtttgaacagacgcatcaaaaatgtgtgaagctagcatccctacttgcaaaggatcagggagcagatcaaaaaagcgcgttttcattccatataccaaattaatgacatgacgatgttcgataacgacacctttcggatgccctgttgtacctgatgtatacaggacatacgccatatcggaaggcgagatagaccaagtcagattctcttttattgatgattcttgaagcatgtcttgaatcacatgaacctcgacatccaatccttcgtgtccttctgcatccgagacaatagctgcagcgccgctgtttttgagcatataccgaattctttcgatcggcagatggacatcaatcggtaaataagcatagcccgcctttaagatgccaagaatggcaatgactagttcagcagatcgatacattttgagtccaacaggagtctcacgtgttatctgactttgagacagtctaagcgcaatgcgatcagataaatgatcaacctcttcatatgtataggaggtagtgccaaacacaacagccgttcgtgctggatgcaatagaacttgttgttgaaataacgacacaatatcacggtccactggataagtgagcgactccccttgaaacgaatcaaacagctgacttttctctacatcagataaaaatgagtgtgtgctcatcatttgctcaggcgtttcgagacattgctctgtgaatcccatgaaatgattggagaactgctccatcatgtggtcatcataaatggaagcatcccagtgaacttcagcatgaaggtgatcttgttctttcttccaaacaataagcacatccgcatgcagctgctctcggtcagcatgcccatgcaatggttcaaatgcacatgccagattgacacgcttcttgtcttctcctactgaacgccaaagctcatccattaatatttgaacaggatagttttgatgacgcactgcctcctgaaacgattgtttcactgcctctagccctgcgctaaagctcatatgaggctcaatctctgccttaagcggcagcatatgattgatggcggattgattggcagactgttccattgtaggaacagtcaccatcaattcagtttttccgctataacgttgaagcaagccaaaagctgctgtggttagcacgataaacagccgcaaatcagaatctccgcataattgctttaacgaatgattcatagccacagggaaggacgaatgaagcgatcggttcattgcagcaggctcggcctttgaaaccgtatgaggaatgcggccatcaagctggacacctgataagatcgatgtccagtaggctctttccctcaccctttccttcgccgctgctttcagttgaaaatcatcatgttcaatcactcttccattcacctctttacttatattttcaagtcatctaattcgaaaagagatacgtcatctaattgctgaaacgaagaagtcagttcgatctcctctattcttacagcatctactgaaacagcccgcatgatgtctttcagcaagcccgcaatccgctctatggtttcctctgtgaaaagctcagtattatattcgatcgttgaagaaagaccgtcttcctgctcatacgcaatccagagtaaatcaaagcgtgacgttcctgtctcatacggataatcactaaaggttaaaccacctaccttcagttctggctgattcatgttttgcaaggcgaacacagcatcaaacaatagatttcggctgacactccggcttaactggaggtcttgaaccatttgttcatattgataatcttgatgtccgaaatcatcgatgacgtgtgctttcacatcctctaggaattgctggtacgtcagctctgctttaggatacaaacgaagtggcagcatattgacaaaaataccgatcacttgctgcagctcctcttgttttctccctgctaccggaaccccgaccgtgatatctgattgtccgcttaatttgtgaagcaaaatctgatatacacttaacaagcccataaacagtgtggcgtcttcctttaaaatcacctgtttaaatgcgtttagctccgcttcttctatacggaacgtataatgcccgccgcggaattgtctcacctctggtcgatcgaaatctgttggcagatcaaggaggggggcaccctctaaccgatctttccagtaatcactcgattctttcagtgcttctgatgctagcaggtcattttgccattctgaaaaatctttatattgcagagcgagaggctcaagcgtcctgccgtcatataactgcataaagtcattgaccaaaatatcttgagaaagaccgtctgaaataatgtggtgcatgtccagcatgagcacgaattcctcttctgccagcttcatcacaccgactctcatcaatggagcctcacttaacgtaaaggcagtcaaaaattgttcaatcacttttttttgctcttcctcagatccttgtgtcgatcccttagtgaggtcaaataatgtgactgcaaatggtacctcttcttcaatcttttgataagggacaccattctctaatacaaacgcagtccgcaaactttcgtgtctcttaataagctgctgaaatgcccattccaacctgctaatatcgagtttccctttgattcgtcccgctttaaactcgttgtatcctgtgctgtttacatccatttgctgcatgagatacaaccgtttttgcgcagacgacaaaggataatgctccttcacttcggctttttcaatcgcatgataagcagcagtatctgcttgatcgatatatgctgccattaatcgtatcgtaggtatttggaaaaattgtggcagcgtcagctctacactaaatgcacgatgaatgataccaatgaaggtaatcgcctttagagaatctccacccatttcaaagaaatgatcatctatgccaatttcatcaatcttaaagaaagcttgccaatgttgacttaatgctttctccagctccgtttctggtgccgcataattcgtggaaagcgctggacgagaatacaaattgccatcttgttcatgctcaccgccgctctcttcctcaagggataaacggtctacatatcggtgaatacgatcatgtaaagatgttgttgaaataaccatttgttccacttgatccagtgaaagcaatcgttcaaagatcattcttccttctttttctgtaattaacgtttcggtgacatcatctccgattggaagatcaagctgcttcccttgctcaaattcccagccgtcaaagctaatgacagaccactgtgtttctgaacgtagattgcgttcatacacgtacgcatcgatgaaatgattcacagctgtataagctgtaaagccgagtccgcccaagatcggtgacaaagatgacaggacaaaacagaaatcaagggatcgatcacctaaggcatcatcaagatgaagtacaccattcatcttcgcttcaaaatgcggctccgaaaaagtgacatctgtttgctccatcacctggaaggattggtcgcctgtcactccagctgcatagatcacgccattgatctgtccatatgacgcatccactgtgttgatcaattgctggatatcttccttgtgacgaacgtctactttctgaataagaacgtctgcgcctgcctcttccagtgccatgaccctttgtatttttttctttgttggatcctgatcatcatgcgtagacagccattcttgccacttgctcctatcagggagtccagatctgctcgttaagatcaatgttccctgtgtttgctcggccaaagtctgggcgatattcaatccaataaacccaagtccgccaattaaaatgtacacaccatcttttttagccaaatgagcatgtcccgtttcgggaactgaacctttcgcatactttttcacatatcgtttatttcgtcgatagaccgtgagaagcggtccagacgctcgatctagctcatcgcttatttgctttagcaatctcttttcttgaaccccattttccactggacgatcaatatcaagaatgcggtaacgtaagttcggtgtttcttgtgaaatcaccatggcaggccctagatggaccgctttttcaggataaagtacaggctcaccgccaacggcatacgtcaacgaggaaagtactgtaatcgataccttttggtccaacacatattttttcagtgcctggccgatgtaaagcaaggagtaataagcttcttgctgcgtttgcttcacccattcttcttccgtttgagatggctgtctttctgaaagcccccatagatggcaaacttttgacacgttgatttcgtcatctgccagatttgatatgagcctttcataatcagatggctcttgtgaccgaatggtatagcttttttcgtcatgcttcgtaaattcatttcctttacgaaccatgacggactcgttccgtttcgtcaggagctcagccgtaaccttctctccaaatgcagatggatctgcaaacaaaagcaaggctccgtcagacgtatcttctaatggcacgcaaggtaaaagatccgcttcccaatgaggggtatagaaccattcatccatttgctgctttcgtccagactgctttggtttgtcttgtttcacacgatctgctgcatcataccaataggaggtttgatcaaatgcatacgttggcagcggcattttccgcggctgacggtttaaatggaacctatcccaatcaatagataatccgtttgtccatagacgtccaatttgaccaagtaaaaattcagtatccgtcacatcttgttttgcatgccttaacacatgacatacatgctggttcaggccgttcagcgaccgattgaccatcacgcttaaatcttgtcctggtccaatctcaattaattgaatattgtcctcttgtaaaatatttgtgatcccttcagcaaaacgaactgtatcggtcatatgccttttccaataagacatatccttcgctctcgtatctgtcatccaatctcctgacaaattcgaaatgaatggaatgcgaagagactcggctttcatatgtgttaatttttctccgaattgctcagctgcctccttcatgacatgtgagtgggcggcaatggttccacctaatcgcatacacatcaatctgttgcttttcagctcttgttcaaattcactgatcgcctcttctagacctgacacaatacatgatgaatcattgacaaccgcgagagaaatatcttttggaagcatcggtttgagctctgcctcaggtaatggaacactcatcatgacgccagctggtgacgactgcatcgcattcgcacgataggcgaccatggacattgcgtcctttaagctgaatagccctgatatggcggctgccgttaattcgccaaagctatagccgatcattgcatcaggacgaacgccccattcaatgaaaagcatggataaggcatattcaatggcaaaaatggctggctgtgcatattgagtacttgccaattgttcacgcgccttttctgtttcagccgctaatgggtacagaatacgtgcaagacttcgccccgttgcttcttcatatgcttgaaaacaagcatccatttgcttcttaaagtaaggctcttcccggtacagatctaatcccatattgagatattgattgccttgtccagaaaacataaaaataatcttttgtttctccacatgcgaatgcatgagctttccaatgcccttgccttgcttttctgttaatacgcgtaaagcatcttctctgcttgccgcaacaaatgtctgacggaaaccaaaggattgtcttcctgtttgcagcgtataagctgcgtctgccaaattgatagaaggcgtgttgtctatttggcttgcgagtttggctttcattcgttccaagctcgttttgctctttgctgaaagaacaagcagctcagcagaacgaggcatttgctgacggtctctttgtggcgcttcttctaatatgacatgtgcattcgttccacccattccaaatgagctcaccccagcccgccgcaaatgggaagctggctgcttccagtcggtcagctcagtattgacaaagaaaggactatgatcaaatgcaatgttttcattggcttttttgaagtgaagactaggtacaaatgtgtgatgctgaagcgaaagcacagctttgatcaagccagctgctcctgccgctgcatccaaatgtccaatattggttttcacagacccaatgcggcaaaattgttttttctctgtgtcgaaagcctttgtgagcgcctctatttcaatcggatcaccaagtgatgtgccagttccatgtgtttccacatattcaatcgtatctggtgaaacatctgcttgatgcagggcatcctgaatgacacgtgtctgtccttcgacgctcggagcattgaaaccaaccttttgatcaccatcattgttgatggcagagcccttaatgactgcataaatatggtcgccatcttctatggcttcactaagtgcttttaaagcaacaagaccaacaccatctccgccaacagttccatccgcttgatcgtcaaaggcgcggcagtggccatcacttgatttcaccatgttctgttgataaacatagcctgatttcactgggtgcaggattgacacacctcccgcaagagctacatctgaatcaccattcgcaatggattgacaggccaaatgcaaggcgaccaaagaagttgaacaagcggtttgcagcgtaagcgccggtcctttcaaattcaatttatgggcaattcttgtacttacggtgtacgtatcattgagtgaacccacttcaaacagctctgacatactgctatcaagggaagcggcaaaacgctgaatccattggaagttcgatgtggacccagtaaacaacccaaccttacccgtataatcttcttgcacataccccgcatcttctagcgccttataggcgtactcatgcaggagacgtatttgaggatccatcatttctgcctgacctggcgaataaccgaagaaggatgcatcaaataaatcaggtccatcaatgacaccttttgccctcacataatcggatcgttcgaaggtttgacggtcaataccggcttctagaagttcttcatcggaaaagaaggaaattgattcttctccattcttcaaatttcgccaaaatgcctcaacatttttcgcacctgggaatttaccagccattccaataatggcaatcggctcattggcttttcttgtcttttgttttacaggctgcgcgtctgccgctacttgctctgaatcgccgcttaaatatgcggcaagctctctaatcgttgggcggcggaacatttcgaccattggaatgctttgattcaattgcttagcgagctgttgattgacgtggatcaaattgagtgaatgcccgccaatgtcaaagaatttatcatggacacttacctcatctaaaccgaggacttttttccaaatgtcttgaataactttctccgtatcagaaagattggcagatcccgcctgttttttcgtttgctgcgcctgtttcaaagcaggtaaagctcgtttatctagtttgccatttgcagtcaatggcatatcgtccaattgaacaaagtgagttgggatcatataatccggcagttgatcagccaacgcttgttttattgccgcttgatcaattatggctgtcgtgacaacatatgcagccaaacatggtgtaccagaagcatctggctttacaacaactgctgctgcttttattcctggctgttcattcagccaaaattcaatttcaccagtttcaatccggtagcctctcagcttcacttgatcatcatttcgacctaaaaattgaatgagcccattagggagaatgcgcgctgcatcacctgttttataaattttttcacctggctggaaagggtggtcgacaaatctttcttcggttagttctgggcgattcaaatagccttttgcgacaccttttccgccaatatataattcaccgacggctccttccggcatgagattcatatgtctgtcaaacagaagaatatctgtatgctgtgcaggcttaccaatcggtacatacacgtcttgatcgagatcctgatcatatcgatgaatcatgcagccaacgaccgtttcagttggtccatattcattcacaatttcaattggctgcgggaaggactgctgaatggatttcgctaaagatgtttccagctgctctccgcctaaaatgaaacatttcatttggctgtctgggaaagacaaatgcttaataaactgtaaatgagatggtgtcagtttcatcacatgcacgcgattgtcttttatgatgtcttcgacaagcagctgccggttttcatggtgataaatcatgatggtatttcctgaaatgagcggcgtgaaaatagaagtaaccgtcaggtcaaaggacagtgaagtgtacaaagcaaaatgccttgtttctcctcgaacatatacttgcttcgcccattcaatatagttggctaagccaagatgatgaatgagtacaccttttggtcttccggtcgttcctgatgtataaatgcagtaggctgtttggtctgaggtgatggcttctgccaagttgtctgatggtccggtgtatagatccggctgcgtgatatcgattttttctccatgataggcgtaggtgagcccttttattgggtgagttaagagccattctactccgctgtcttctaatagatattctattcgttcctgcggatattcaggatcaatcggcacgtatgcaccgccagcttttaagatcgctaagcatgctatcaccatttcaatggaatgctctgctaaaatgccgacacgctgctcctgtttgacccctttgttttgtaaataatgtgcgagctggttcactctcttattgagttgttcatatgtaaccgtcgtatcgccaaactcaactgcagctgccgctggcgttcgctctacttgtgcttcaaataggtcaatcaccgttggctcattgctagatgttgctccgtcatattgctggaagaccgccaactgcttttctttctcttcttctgatagcagctgtagttgagcagcagttttgtgcggatgagcacaggcatcagacaggagatgaagaaaatgctgacaccacttttcgatttgctcagctgaaaagctgacggggttatacaccaatgaaaagtgcagctgatcatcaaatgcctggacactaagcgtgagatcgaattctgtctgctcagtcatctcaaatccacgaatacgaattggctgatcgtttttcgtgagcatttgatctaatggatagttttcaatgacgacgattgaatcaaataatgattgctctgcagtcattcctgcataattctttaaggcagatagcggggtatgttcatattcatttcttacagcgatctcacggctcacttcctgcatctgttcaagaattggccgttcctgttcgaatgagacccgcagcggtaatgtgttaatgaacagcccagtcatcttttcaatatgagggacatctgcatttctccccgatactgttgtcccaaaaacaatatcatcttggttggcatacttagatagcaaaactccccacagcgtatacatcacagatgccagcgtcacgtcatattgattcgtgaatttgctcaggctctcggcaatggacgtatccacttgatgttcatattgatgaaacacttctgaatgttcatatgcgccgcttgacttcggaagcagttctgcataactccagccgttgaaaacatttttccaataggcggcttgttcttcagtctgttgaaggtttttctgctgccatttgacaaaggattggtaggatggtctttgttccagaagaggtttgtccccattcgataagcgctcatatgcactcatccaatcgcttaatacaatcccaaggctccagccgtccaataaaatgtgatggaagctaatgagaacccaactgacttcatcattcacttcacataacgtcaggcgaaatgggacttcctgcagatcaaagcgttcttctcggttctgtgccgttacctcttctttcagcacatgaagaggctccttcgcttgtgtcaaatcacgataacgaatgtctggctgatgctgcttcatcacaatttgtactggtcttgcgatttcctgccatctgaacaatgttctaagcatttcatgctgtttggtgacattcgtccatgattgttcaaaaatgtctcgatctattggtccgtctatttcgatcagcagttgttcaaaataagctgttccgttcggttccattaaatgatgaaacagcagtccttcttggatcgtagtgatacctaacatattttcaatgttctgtttatccagcttctgcggctgtaaggccatgggctcatctcctttctctctaagaatgtttcacgaaataatggcgtaaaccatagttagcaataacctgctgctgaatttgcgaagtcccttcaataatttcaagcaccttcgcttcacgatatagtcttgaagctgagttttcccggctaaatccacttccgccatgaatttggacatttgtatttgtaatgtcaacagcgattttagaagtgaaatattttgcaatggatgtttctgtgatcgcatcaggatgattcgcttctctcatttccccggcctttagacataaagctctcgctgcatggagctgagtcactgcatccccgatcatgcctttgatcatttgatgcttgtacaatttttcattaaactgtgttcttttacgcgaatacgtgacaagagaatcaacagcttcttgtgcgatggcaagccctgcccaagcgacactgtatcttccatggtctaatgcaagtgacaccacatggttaaatccgcccccaactggtcctaagacacagtcttcatgcacccggacatgatcaaaggtcatttccgctaaatatgacgctcggttggccatcattcctgtaattctctcaatctctacacccggctgatctcgatcgacaaggaatgccgtgacttgttcaccgtctcttgcaatcacaataaagaaatcggcaatcgctccaaaggatatccactttttcgtcccatttaatacataggattgtccttccttttgatagcttgtttcaacatgattggcatctgaaccaatattcggctctgacaaagcaaaggctccgattttttctcctttagctaattcaacaagccagccttgtttttgatcttctgttccataacgaagaatggcttctcctacaagtgaatttactgtcaataatgtgcgtacattacagcaagcttttcccacttgttctgtgaactgtccatatgcgatcggatcaagccccagcccttgataggaagaagggatacctgctgccaagtagcctcgtttcgccatatctcgaatcagtgactctggcaaatgttccgtctcatcgaattcattggcaaacggacggatatgttcatcgcaatactggcgaatgtcttcaacggcattgatcgtttgttcaactgttttcatgaagagctgccccctgttgttttctctcaattaaggcgacaatgcgattgaccgtactaaaatgagcaatgtcgaggtcttcgttatctaattggaattgaaagtcatgttcgatatagttcactagtttcatcgcaaatagagaattcacaaagccttgttcaaaaatatgatcatcatttccaagctcaatttcctcatcaaataccactaggttttgctcgatataggctcttacttgttcgtgtaggttcatgatttaatctcctcgcttttcgcttttttattgtttggctgggtctttctgatttaattcgatattgacatctacgtattctgggaaaggctgtatcatgcttaaatcattttcaaacaagatatagccatcctcccccttctcaatttctttgaaattggcaaacttatatgtgatgtacatcatacggtttcgatcggtttgtttaaaatcagcgacaagccgctttcctcgctttttcgcttcttgcaaaatcgttgtgagtaagatggtcccgacaccacgagacatgacgcggcaagacataagcagcagtttgacatgccatgtgtcacctgtttcttctattaatgagagtccaatttttccataggaaccgaatttatcttcaagttcacagacaagcagcaagtgggaatctgattgacggaagaaatcaagctcttcataatcgtaggttttcccgctcgcatttaattgattggtacggacggtcaattcttcagcgcgttggaggtcttgttctcctgcttctgatatcacgaatttcatttgtaaagacgccaagaatttctcaggcggcccttcatatttctcttcttcctgctgccttttgtccgcttctaagtacattcttctgcgtcgtctagcatcttctgtgataaagactggacgcaggcgatcatcagtgagtaatgacagataatccactgcatcccagcacgtaatctctggatgaacagccttcacttcttcccgctcaaatggctgatcatcaataaagagaatggtatctttatgaatatttaggcgctcactaattctctctaatgaactagatttggcattccaatgaatctctggatatagaaagaaatgttcaattccgaaggcagaaagcttttccttcacggctgcttcatcattccggcttgctatagaaagaaggatgccacgcttatctaactctgttagtacttccttcatcgatggttttaacgtcacttcatctgactcaagtaaaattccatcccataatgtatgatctaaatcccagacaacacacttgatttgcttagccattggttattctcctctcacatgtcatattggaaaaagcccttgcctgattttttgccgtactcgcctgcatcaaccattttgacaagcagaggacatgggcggaacttcggatctttgtagctctcgtataaaacaagcaatgaattcaaaatcgtatcaagcccaattaagtctcctgtcgcaagtggtcccattttatgaccgaaacctccgcggaaaattttatcgacatccgctggcgtggcaacttgatcttgcaccgcccaaatcgcttcattgattgtcagcatcagcacacggttggaaacaaatccaggaaaatcatgcaccacaactggtgttttatcaaacgatttcaagaaaccttttgccgtttccactgtttcatcagaagtggcttttcctctaatcacttcaactaacgctttaagaggaacagggttcataaagtgcgccccaatgacattctcaggatgatgcataagggaccctacctttgtgatcgagatacagcttgtgtttacaaaatagatggtttctttcgcacaaatatctcgcagctcttcataaataggtttttttatctcccaatcttccgtcacattttcaatgacgatatgcgcatcatgtaagccttcaagtgaagttgacagctggatttgagacagaacatcctctaaagacaatgagattttcttctttcgcacaaattgaaccagttgataggtcttcttgattttttccagcgcttcgtttaacttttcttctgtgacatcaactaatgtgacttgatagccatttgctgaaaggtctaatgccatatcagcccccatgacacctgctccaatcacacctacgtgcttcgtgttcatttctccaacactccaattcgctttaaaatgacattgattttttctacgacttcatttgttaatgaatgaataaaaaagtgatctccatcgaattcgaaaaacgcacaatcttcgcttgtatattgatcccaatcctctaaatcaaacagcacagaaggcaaatcacgcgtaccataaaaaatagaaattggacaagcagctggaacgacttcatcacacaaataggtctccaaaagctgaaagtctgctcttaaaatcggcagaaagaaatcaagcactgcatggttatcagcaagttcctcaggaacgcctcccatcgcaatgatcgcctcttttaatttggaatctgacagctgatgatagactttcttttctggaatatgtggcgggaagcgcccagaataaaagacatggacaggctctctgtttaaccttgttttcattcttttttgtaattcatatgcaaggacggctcccatgctatgaccgaaaatggcatagggctctccttcttttaaggaagatgatgcctggtcatagagatcatctgcgacctgctgtaaatcggttagaacagactctgtcattcttgtcccgtgcccagggagttcaagggcatgaatttctatcgaccggtctatataagatttccacgtactgaatacggtacttgctccacctgcgtacggtaagcaaaataatttcacgatacgccacactcccttttgcatttcatttccaattcctccagccagtgtttttcatcatgaatgatttgttctaaagaagctttgatattggcttggtacctactagacatctcacctgaaaaaaggagtttcgctgcctgatgcctcgctttctcccattctgctaaaatacgttccatccatcccaccagctcaggtagatcgtctttgatgagattcagtcgatacagctccactttcttcgtattgatgatctgattgaaagacgccacgagcctctcaatatcatcccattgcgaaaactgctcataaaatgtttcaagagctgtgattcctttttctattgcgtctatctgaccatgcatatttctcaggaaataagtcgttttttgattaaataactcagtcgagagcttgtctggatcaaagtagaaagccgcataggaatgaaattgatcattcggctgaaaatgatcatgaaaggtgtcataccctttctgtacatctttaaatgacagcacttgatgctcgtaagacaaattatctaaatgccgattctctaatacgtgaaagatttgctgattttcatcgaatccagtgattaaaatggaatgacggctatgggttgtcaaatactcttttctgcctcgctgaacgtaagggtctacccaaacgattaccgggcggtcacatgtcacatcttgcttgaccttttcaatgaggttgggacaatacgccattttttcgacttgaatgccttgtgcattcataattttttctggatcgtgtgccgacatccagtcaatctgtagcaagccattctctgtaagcacgtaggcaaattgatcatttagtaagtatggagcaacttcttgattatgcagcttcacaattggaaaaaagcaattgaagaaacagctgcgataaaacaaatcattataaggatgaatgcccgaaatctgtttgacggtcatctttttttcctctctttccagcaggagatgtcaccataaatcctttgatgaaaccaatcgtacaaaaccaaatgaaaaacaaataataagaaatcgctaattcaatgagagaggaaggtccccatacaaaagtcattttccaaggcagcccattaaaggctagctgcgcaacaatcattggcaggagcaatatcccaattagcagcagcacccagccgctacttttcagccagacgcgcagtgacatgtctctgcgaactaaagcgccgttttttacacgctttttccacttgataaaacgaacgatagacactatttgcagcaaaatgaacagacatgtggcaccaaggctcaattgatcaatgagctgaaaaggatccattgatgactctgcttcttcatttgtacctgtgattgttttggcaattagacgtgccgtttgctccgtgtagctactattcatatttgctaacactccgatcgcaatcccttcttttggctggatcagaaaaaatgatgaatagtttgggttagagcctgcatgaaaaagcgagtccacctgctcatgcgccttttctatataccagccggcattgtaatagacatgcttcccttcttctgggacattcacagttaagtgatcaggattttttacaaagcgagaccaagttgaatcggtcaattgatattgcagccaagtccccacatcctgactattcatcacaatatagcctgcaggggtgttacctcgatattctggtgctttaaaaacatgcggagcaaggaattgaagtttaaatccttctgagacagcaccggatttcatccgttttagcccagcctcggtttggtcaagatgatgccttttaaatagctctttcatataagcctcatacgatgttcctgttacattttcaatgatgagaccaaggacatcatagttgatggtcgcatattcaaaggaactgcctggcttacgattaagctcgattgatttcagctgatcaactgtttttttcaatgcatcctttgtagtatcaggctggatcagcgcaatagattgaaaaggaatgccgcttgtgtgatgcattaattgctccaccgttaaacgctgaggctttccattgtatgttggaaaaaaacctggaatatagctgctcaccggatcttttaaatgaagttttccttgcttctctaactccacaatcgcaagagcggtaaacgcttttgatgtagatccaatttcaaagaaagtgctggctgtcacttgcttctttttctttcgatccgcatatccaaagcctttttggtacaccacttcgtcctttttcacaaccacaacggacatgcctggaatgcgtccaagctccatctgttgctctatcacttgatcaatggttttagatgaaatcgctgcttttgcatgtatccccccggcaaagctgcttatccataagatcgctaataaaaatgaaagatacataacatactgatttttcctcatgtaaataatgaatccatttcttcaagggacatatccactgtttcaaaatcagacggtgtaaattcgattccttctttctctaagcaatgctgtacaagacgctcaatttgctgttctaccgcttgcaatagctgcgtcatgtctgtttcacacagctgtttttcgctgaaagaaagatggaaaatcagctgaccacccttgatggtagcgaccatatcgatgacggttgttaatggattatccaatgacgagtcaatccccgatgtaaagtaagacatctcataatcagatgattgtttaagcacttgatcaatttcgcctagatagttaaaacgtaattgtggtgctgaatgacgaggaagctgctgattgatgagtgacaacagcccatagtctgcacctttatttggcacttctcgtatcgtttctttgacaacacgtatgtgatctgaaagagattcagacacatggacattcacagggtacatggtggtgaaccagccgaacgttctagatacatcgatctcatcctctacagcatccctgccatgaccttctaattccaaagaaatccgctcttgattcgtttgctgataacaggcttgcgtcaaggctgaaattaacagttcatgcggctgcgtttgatacgcttgattcgcttgattgagcaattgattcgtgagttccactgataatgcgttggttaatttgatttcgtctctgacatatccctcatttgaggaaactggatacagaggctgaatattttgcaccgctttttgccaatagctgaccgactcttttacaccctctgatcctgcatactgattcacccgctcggcaaatgtttgataggaatgggttttagacggaagtacttctgctgtaaccttctctgcatgcaataattgaatcaagtcctccacaagaatttgccaagacataccgtcagctaatagatgatgggcggcaaagatgagatgtgattgagaatcagtttgacatagcgctgcctgaatcaatggtccttgataaagatgagtccgttgcttgacctgatatcctacttcttgtaacgcttcttccacattctcttctgacagtgctgtgaaatcgtgtatcatcagcggaatctcttgaatgtgttcatcataatagagtgtgtttgttgcctcatgtacttttaaccttagtccgtcatggtgaatgacgagctctttgagagctttctgcacaatagtttcatccatctttttctttgaatgaacaatgatggattgatgccagaaatgttcatcttttaaccgctgggaccagaaccattcgataattgggatcgatttcacatcacccatagcttgctcttgtgagatatatatgacaggttcctgctgaaccacttgtgccatttctctaaaaatgggataagtaaaaagatccttggtttttaaataaagtcctttgtcttttaacttcgcaataaattgaatcgccttaatggaatctccgccaagctgataaaaatgatcagccggttcgattgtttcatgccctaagatgtcttttgctgtatttacgatgatctcttcaatgtccgctgtttccttggaccactcaacagctgtttccacttgagacagcaatggatcaggcagtgctgtccgattgatttttccgttttgagtgagcgggagctcgtctagtacaacaaaataggcaggtaccatataagctggaagctgatctgataatttctttctcagtaaaaaggacgtcgtctttttttcttttaattcaatataggcagcaagctgtttttctcctgattcatcggttagatcaataacagctgctttatcaacttcttcaagtgccatcaatgcaagttcaatttcaccgagctcaatccggtagcctcgcagcttgatttgatgatcaatccggccaatgtaatcaatctttccatcatttgctcgtttggcgatatcacctgttcgatacatgcggcggccgtttacaaatggattgggcagaaagcgtgattcctgcaaatcaggtctttgccaataccctctgccaacccctgcgcctgaaatatagatttctcccactgtcccaggcaacacagcttgctgattctcatctaaaaggtagatctctgtattgggcattggcacaccaattgacaccgatgtccctccatcatcttgatggaattgatgaatcatacagccaacggttgcttcagttggtccatattcattaaagatggatatccttccatcacttgcctctgtgattctttttgccaaagcggtcgataattgttctccgcccacaatcatccgtttcacaactgattgagaaagtgcagcatcagttaacagtgccatatgagctggtgtcagcttgatgacttttgctttttgatcaaacaaaatatgttctaataaaaagcctggctgatcctcttgacgatagatcaccactgtactgccaatgaccaatggcgtataaatggatgtcacagttaaatcaaatgcaatggatgaatacaaggcaaaatgatcatctggtgaatcagtatagtgtgttttagcagacataatatagttcactaagcttccgtgctcaatcatgactccctttggctgtcctgtagagccagatgtataaatcatatatgcgacgtcttcatcattcccagtgaatggatgttccggattatactgatccagctgattccacacgctgttgatattgtacgtatcgccattaaattggtatgcagatgcgtcatttgtgaaaaacagctttgcctggctgtcatccaaaataaactgaatgcgttcctctggatactcaggatcaatcggtacatatgcgcctccagcctttaaaatccccagcagcagcacaatcagttctggtgaatgattcatacatacggcaacaaagtcatgtctttgtaagccatgtgtttgaagaaaatgcgccatttgattggtttttctctcaagttcaccgtatgtcatgctatgagatccgtcctgaagtgcaatccgatcaggagaagacgttgacatgtttgtgatcaattcatggattttttgtttctgtggaaattgcacgcctgtatcgttccattgatatagctcccgatgttcctcgtcttctgtcatgagaagtacgtcttttaacagctgctttggctgagcgagtatgttttcgacaaagagaagcattctttcgtgtagaaagtcgatgtcttcattgctgtaatctgagatcttgtagtcatattgaagctcgatttgccctttttcatcccattctttcacagcaacttgtaagccatagggctggaagccattgtaaagctctatgtattcaactttgtatccttccatctcctgcaccatatttgtgctgtaggagttgatatagatttgaaaaagctgatcataccctgcttttgcaagctctaaatctttgacaagtgcatcatagggataacgctgatgcaggaagtaagccttatagcttttttgaacgtctgttaaactttctaacaaagatagatgaggatccatcttcattcggtatggcattgtactcacggtcataccggacgtggctttttccttttgtccggaacgattgagaactggcgtcccaataataaaatctttttgctggtatcttttatgcaagtaaatgaaaagtcctaaagtaaataaagagttgattgaacaatgatgggtatctataaattcatagattcgttctgagagttggcgatcaaggtaatggctttgccgatggcctttgatttggtcagttccctgtaccaaataactattagacacatcagataatgcttctttccaaaattgctgatcttttttaaatcttggggagttcctatattttgattctttatcaataaatacagaatgattgtctgcttcttgttcgatagaggagctttgggtaagagcagtgtaaagctggctaattttatcgatgattactttcatcgaccatccatctgctactgtatgatggcatttgatgaaataaccggattgttgttcaccgatttttagtaccgcaaattcggcgagagaggtttctgttaattgaaatggtgttttgaaggctttttcggcccattctagcatgtcttcatgtgtggaaaactcataggtaggaatagtgtgatcggcgtttgggtcaacgtattgaagcgtttcaccatctttctctattagcttgagacgaagtgattctgtcattatgatacaagatgcaatggcctgcttcagtttatcgagctgcaacggcccattgacgaaaatgatcccgccaatatgattgatcggtgtttctggataaaatgtttccatgttcatcacgcgccgctgcggatgtgttaatggccaatatactaaactactagtcaattacgccacctctacttttcatatagttaacatttcttacgaacatattaaagcatataatagtatttttgtaaataattgagataaaatgtctaaatttgttcattttttaatctagacgctaggaaggccgacacagtaaacagggcgacatttataaaaaagacgactcttgccccaaagagatcggtcatggtactcataacaagaatggacatcccgtatataaaagttgatagtgtatgttgagctgatagtattttgggcaattcaatttcactcagtgtatcttgtacataggtccgaatggaaatgctgcgaagctgaaaggctggccctaataaaaagacaaacaacaaactcatccatgcagaatgattcaatcctaaacaaagggttagcacagcaacgatcaccgaactgtaaaaaatgtgatcaaacaaacgctgttccacatgttttgcgaaccgcagtacgagcaggccgcctagaatggttccgccaaaatagcttgcgttaataaagccccaccatgtttctggctggtgtaagacttctgtgacatacacaagaataatggcaccagtccatatacttctaccactcatggatagcatttctaatatcgttaatgttcgaatagtaggcttagcatacatgagcttccatcctgaaaagacccttgtagtaaatgattcagactgttgctcttgtttagctgcagccccagtatcaatgataaagagcatagataggagcgacaaactgtataaaacaagtgtcgtcaataggagaaactgtggtccaagaatgccaataaacagccctcctaacagccagcctagtaaaaggaccatttggtcagaagttaagatataactattagcttttagtaaaaagttcttttctactaaacgcgggatcatcgaatttcgaacaggaatcgttcctccatctatcaaagaaaggaaaaatacaataataaaaaagaaaggaatagtaaaagttgataattgtagaatataaatgaaaatcaagcagccgaagaaagcaatttgacacatttgtaaatagataatgagtctttttagcttaaattgatacataaagaaaggaataagtaccgccccaagtgcttgtccaacaaactgcgagacagccaccattgaagcaatcagtgtagaatttgttaattgatatgtcaggatggttaaaacgaggacatataacgaatccccaaaattagctaaggattgtccccctaataaaaagtaaaatgatttgtttttcatatttgtctccattttctcttcattatcacccataataatacattattttctacacttctactttttataacaatatattcttaatttgatacatttttcctaatttaaaaaaccgccaaaaggcggtttttatttagtcatatatatggatggttggttctttgtcttcagcatttttcgtgatcaaggcttcttgttgatctgatgatgtgatgttaatttcgatattggtactcttatagtaatccatcacttcacctgttaaatattgcgtgaaggctacgacttccgtttttccgtagaactgcattggaatttcgactttcattttttgcaggttcccgtttttgtaaaagccttttcctacgacacccgtgtaattcgggaagtagtcttcgacttttgttttgaagcggtcaaatcgctcggaatcatctttgtagttgcctttcgcattatctgaagggaagaagacattctcctctttgatcgtatcccaattgccaatatcagctgagcctgctttcacatctgttttggcgataaagtttcctggcacgatagatgattttggtgcttgcttataaagggcaatcatgacaggcactttttgcagcccatccatttgacgaattcgtttgatcacttgttcagcaattttttcgccttctgacagtagtttctttgaatttttcgaagaatcgatcgtcacttcttgctgcggatcaccgatattttcacggtaataataaacagagttcagcgcaagtccaatgacaactccgcccagctgtaagctgtttttatcttttcgaattaagtaattatgctctagcatcgaagctaagtaaattggactattttcatttttagactttgttgaacctgagttcgggagagcaggatttaagcctaaattcttaaagtccttatcttctttttctgcctttttcagatcactgcctgtttttttgcgcgccagccagctgagaacggtgtcctcgtctaaatgctgtccttcttggaaaaggtagtcgtttgtattaaatgactctgttgcgagacgcatgagtcctgtttcaaattcatcgatgtccaaacgtgtgttgagacgctctgctgttaatcctctcgcagctccttgtttaaacggcagcaccattttgtaataagagtcagagatattgtacatcgggatgatggctgtttccttcgtttcatccgttttttgtgtgacctcttcctcatcctttcccccaaaaggtgcacacgctgacaataccagtgtgagcattgtcagcagcaataacaactttttcaatagaaaacactcctcttatttctttagctcctcgagcattttagcttcgtcccaaatttcaatattgagttcttctgcctttgtcagcttacttcccgctgcttctccagcaatgactaaatctgtttttttactcacactacctgccagtttaccgcctaatgcttcgatcgcttcttttgcatcgtttcgcgccatttcttctaatttccctgtcagcacaatggttttgcctgcaaaataggaatcactttcttcaaccttcaccggttttggtcctgtataggtcatattgaccccaagctcttttagttcatttagcagattgagtatttcttctttctcaaagtacgtgacgacagcatcagccattttttcaccgatttcatcgacttcgagtaattgttctttcgtcgcttgctttaattgatcgatatcgccgaaatgcatcgccaaggtctttgccgctttagagccaataaatcggataccgagtccaaatagtaaacgctctaaagagttttctttcgattgctcaatcgaacgcagtaaattatcgacagatttttcgcccattcgctcaagttgaatgagctcttctttcgttaatcggtaaagatcggacacacgagagacaagctgttcttggaaaagctgtgtaatgacacgctcgccaagcccatcaatgttcattgcattgcgggaaacaaagtgaatgagtccctcacgtatttgggcaggacattctggattgatgcagcgtaaagctacttcgccttcaattctcacaagctcactatgacactctgggcattcagtcggcatgtgaaacggcttttcttctcctgtacgctgatcgatcagtacgcctgcgacttccggaataatatcgcccgcttttttcacaatcacttgatcaaaaaggcgaatatccttttctttgatcaaatcttcattatgaagagaagcacgctgtactgtcgttcctgctactttgacaggctcaaggatcgccgttggtgtgatgacacctgtacgcccgacacttagttcaatatcaagcagcttcgtcacaacctcttcagctggaaacttgtacgcaaccgcccagcggggactttttgctgtaaagccgagctcttcttgctgtgctaacgaatcgactttgatcacaattccatcgatttcatatgaaaagtcggcacgcttcgttttcagtgtttcaatgagctcaatcacttcctcaatcgtttggcacgtccgtctttctttgttcgttttaaagccaagttcgtcgagaagatcaagtccttcgctttgcgattcaacaccaatttcatcaagctccgctatactgtagacgaaaatatcaaggtttcgtttcgccgcaatttttgtatcaagctgacgaagtgaacctgccgccgcattacgcgggtttgcaaacggctcttcttcgttttgtaatcttttttcgtttaatgcttcaaaagaaggttttggcataaatgcctcgcctctcacttcaattgacaaaggacgtttgattttgagcgggatggaacgaatggttttgaggttttcagtaatatcctcacccgttgtcccatctccacgtgtggcacctcggacaaacacgccattttcataacggagagaaacagcgagtccgtcaattttcagctcgacattgtatgagatatcgtcaccgactgcttgacgaacccggcggtcaaaatcaagaaggtcctgttcattaaatgcattcccaaggctgagcatcggtgtgccgtgacgcactttttggaaggcgtctaacacagcgcctcctactctttgcgagggagagtccgctgcttttaaatcagggtgctcttcctctaaagagatcagctcacgcatccgcgcatcatactcagcgtcaggaacacttggacgatcaagtgtatgatattcgtagttgtattggttcaaaatctcgtgcagttcctcgatccggcgtttcgctgcttctttatccatctgcttcttcctttcaattcatccgttttataagtcctatcggtttattgcttctcaattggcgcaaatgctgcgagaagacgcttaatgcctgtagggcttgggaaggcaatatcaagctctgtgctgtctccactgccttttacactgacaaccgttccaacgccccattttttatgagccgctttatcgcccacagcccagccaatacttccgccgcctgtgttttgaatggtttgagtttgcggacgtgagacaggtccccgtctttgcggtctttctcttgtttggccaaatggtgtttttgtttcttttttctcatttaggttgtccaataaatcggctggtatttctcgaatgaatcttgattcaaggttcatgtttgtccggccgaagagtgttctcatcttggcacttgataaatagagctcttcttccgcccgtgtgatgcctacataagcaaggcggcgctcttcttccatctctgcatcttccattaatgaacggctgtgcgggaagacaccttcctccatgcccattaagaagacaacagggaattctagaccttttgcggcgtgaagcgtcattaaaatgaccgcatcctgatcttcttcctcattttcatccagcttatcgatatctgcgacaagggcgagatctgtcaggaaggtcacaagggacttgtcttcattttgttcttcaaagttcttagtcacagagagaaactcgtcaatattttctagacggctttgtgcttcaattgttttttctgccttcagtgcttcacgatagcctgttttctctaggatttcttctgttaattctgtgacagataaataatcctgcatatttgtcatttgatcaatgagctgtttaaattcatcaagcgcattggctgcccttgcactgagtccaatgaaatctacctgagcaagtgcttcaaacatagacaggtcattcatctccgcatatgccgcaattttatcaacagatgtagcaccgattccgcgctttggtacgttcacaattcgtgcaaagctaatgtcgtcatctgggttagctactaggcgtaagtacgccaaaatgtccttgatctcttttctatcatagaacttcgtgccgccgacaatgttgtattgaatgtttgacttcaataatgtttcctctatcacacgagactgagcattggtccgataaagaatcgcaaaatcggataatttacgcttgccactctgatgaagctgatgaatctttccagcaacaaattgtccttcaccgaattcattatctgcacggtaataggcaatctttgctccttcatcattttctgtccaaagatttttcggcttacggtttgaattgttttgaatcaccgtgtttgcggcattcagtatgcgtttagttgatctgtaattttgctcaagcaaaatcacttcactagaaggataatctttttcaaaggagagaatgtttgtaatatccgctccacgccagcgatagatggactgatctgagtcaccgaccacacatatattttgaaaacgttgagcgagcagtttcacaagcatgtactgcgctctgttcgtatcctgatactcatcgacatgaatgtattgaaattttcgctggtagtgttccaatacttcagggatgcgctcaaacagacgaatcgtcatcataataagatcatcaaaatcgagtgattggttcttgagtaatcgtttttggtaatctgtatagacgtcgctgaccacttgatcatagaaatcaccggctgttttggcgtattcctctgcgtcaatgagttcgttttttgcactgctgattgaacctaaaatgctgcgtggatcaaactttttaggatcgatatttcgttcttttaaaatgtttttaatgactgaaagctgatcagacgtgtctaatatagaaaagttgcgatttaccccaatacggtcaatatcgcgtcgtaaaatacgcacacacatgctgtggaacgtagagatccaaatgtcatccgcaccaggccctaaaatggcttgtacacgctcacgcatttcacgtgctgctttatttgtaaacgtaatcgctaaaatgttccacggagccacatgcttttctgccattaaataagcaattcgatgtgtgagcacccgtgtctttccgctccctgctcctgccatcaagagtagcggaccgtctgttgctttgaccgcttctttctgcgcgtcattcagcccttctaatagatgattcgatatttcattcattccattcaccgccaattcgaacttatgttctattttaacccgtttcgtcttgtttgactatgatgattttttgactgcgctcactgtctttaatgcttctttgaaattgtcataaatgacgtttcctacaacaaccacgtccgcatgctgcgcaaattcttctgcctgtttttcgttttcaatgcctccgccataaaaaagaaccgtatcagaaagcactgctttcgtttctttcacaagctctatatctccaagcgttccgctgtattctagataaaaaatgggcagcttcatcaaatgctctgccactcttgcatatgctcttacgtcatcgatgtccagcgctgtatttgcttctgtgagcttggccgctttacattcttcatttaaaataacatagccttcaggaacgatctcttccattgacatcaaatcaccgaattccttcatcgcgtccttgtgaagcccaacaatccaatcagggtgagagctgtttaagacggtcgggatgaaatacagatcgaagcccggcacaatcatttcatgtgttgagatttcgagcacacatggcacaagaaaccggcggacctttgacatcaactggagcacgttgtcctctgtcacattgtcactgccgccaatcaatatagcatccgtaccagattcacaaatcgcttctagctgttcatcggatatttctttatttggatcgagtttaaagacgtgcttccactcggtaacatcatacatgaaaaatgttcctccattcgtttcattccatttaaatattataacaaaatcagtgaccgcaaaaaatgggtaacctccttcagctaaaagtttcattcttttgaaaatggtgttcgtgactttaggatagaatgctgaaaacatctaggagctgcgagggctgatctttgaccgttcactgataggaaaagctttttatcaccacatgttattatacaataaagggacattttactattgatcaaaaaaccatacataaagcaggtgatctacttgaaaagaaccatcacatatgatcaaacgatcgacatcggatacatctatctcctgcctgtgggaatcgggacaatcaaagaaaccattgaattagatgtgaatgaatgtgtaaacgcagatatcgacaaagagggccgagtagctggtctggagttattcgcagaagaagccgaggttttgaagcatgcacccgtttatgaggatgagctttcgttacgttttacagatcaggacgttctctcaacctttcatttatcaggcattgaatttcatttctcgacgcctgatcacaaagggctgatcggttttacgattgtcgatccacttcgatataacttcaaaagaaagacaagaaaaaaccgttttgaatggtcaaaacggtttttccaaactattgtctcacttcattgaaataatggacggatgtcatggccccttcatcgaccattttgttgtcttgaatatctaatggatcagggtgtccagctttttcaggaatcttttcatctgagcggaacatgcttgcccattttttgagatgctgtttatttttcactgctaataacactgcaccaccaacccctaatcctgcaagtacatacccattcggacgcttattcatgtatgttccctccccttatgatcttatttgtaagttaccccgccttttcatttctaaacgtcacaatctgttgaagtggtttctctttcaatgaaaagtggaataacaacagcaatgatagagaaaagaggggatcttcgtgacaacaactttcattgtcattggcgcactattagtaatttgtttcatcataccaatcattttattcatctggatttgggtgcgagatgaaaaacaggaagagcattctgtcctgcgaaattatccggtcattggaaagctgcggtttatttttgaaaaaataggacctgagcttcgccaatatctgtttctgaatgatcgggaggaacttcctttctcaagaagagaatacgagcaagctgtcatgtctgggaagtacaaaagccggacgatgggctttggatcaaaacgtgattttgacaagcctggttactacattcgcaacgtcctatttccaaagcagcgagatgagttacgcatcgatcaatctgaaaaaatccaaacaaaagtgtaccagattgatcaagacaatttactgcgaagaagtgaacataccaaagaggttgaagcaaaaccttactatctccatcaagaggatgtccaagtgattggcgagcacacatgtcaaaagcctttccgtgtaaaaggcctgattggacagtctgcaatgagctacggatctttaggcgacagggccattacagcactatcctctggattaaagatggccggcggtacgtggatgaacacaggtgaaggcgggctttctccctatcacctcaaaggcggagccgatatcatatgccaaattgggcccggtctatttggcgtgagaacagaggatggcgatttttcctttgaagaatttaagaaaaaaagcgagcatgaggaagtcaaagcctttgagctgaaactggcacaaggagctaaaacacgcggcggtcatattgacggcaaaaaagttaccgaagaaattgcgaatatccgtcaattgccgccccaccaatccattgacagcccaaaccgatttgagatgttccactccattccggatatgtttgatttcattgaacagctgagaagtataggcggaaagcctgtcggcatcaagcttgtggtcggacataaagaaaacattgaagagcttgcggcgtacatgaaaaaaagcggaaagcatcctgatttcattacagtggatggcggagaaggcggcactggtgcatcctttcatgaattggcagatgccgcagggctgccgattttcacggcactcccaatggttcatcaaatattgaaggaatacggtgtcagagatcaagtaaaactctttgcttctggcaaacttctctcacctgataaaattgcaattgccctttccatgggtgctgactttgtcaatatcgcacgaggactcatgttttcagtcggatgcattcgcgcccaagtgtgccacacgaataaatgcccagtcggggtcgccacaactgatccaaagctgcaaaagggtttatcaattgaagaaaagaaataccgagtttgcaattatatcctttctctaagagaaggcttgtttaacttatccgcagccgctggaattgaatctcccattcattttaatgagaaacatattgtctatagacaagaggatggtcagacaagtgaagtgcctatttttacaggaacacagccatccgtatagtttgagaaaggtgcgtttttgcacctttttttcaattgacattttggctcaattgcgtataaagaacttagagaactgaccaggaattggagagatggaggatgcgtgagaaaaaggttcgcgggatgaaacggaagacgaatgagatggtgacaagaattgaggaaagtacacgagagttcccggcagatattgaacaaagttattggcatctgcctctaccggttgcttatgattttatttgtacaagcaaaacacctcaaaaaatcaagcgattgtccatccagacactgataaatagagctgaacatctcattgatttgaagccaattgatggagaagtatatcgcgttgtggttgcagtagatgccactaaattatggggttcacaaatcattgtgtttaaaggagattcctattttaaagactttttcaatagacatgatgatgatcagagttggctgcctctttccggtgccagaaacattcaaagggaatggggtttatctgtgccaaaggataggcaaatcataggttttaaagacatcatcgctgacgaagatggcatctcttacgaaggcgaaagatggtttatcggcgagctaaaataaaaaacaggacccgcttcactcagccagtccttgtttgtcttttcagcgctcttcataaaaaaactgtaaacaactctattcttgttgaaaaggattgtttacagtgaaagctgctttattttgtttcgtcatttgtctgctgttctgctacgcggtcaagtgccatcgtataggcatcatttccatagttcaagcagcgtttgacacgtgagatggttgcagtgctcgcacctgtctccgtctcaattttatgatacgtgttcccctcgcgaagcatacgcgctacttcaagacgctgtgataaagattggatttcattgatggtacacaaatcatcaaagaatcgatagcattcttccaggtctttaagggataagatggagttgaataactgatctaagcttttgccccttaatttatcaatttgcatctttatacatcttctcctttactattggcaccgcttcgcacgacaatctgcggagaaagcggtatctttcctgactaatttttttcaacctcagcaatgagctttgaacgaatcatgacaggtttggttatacgctggaaatgccgtcagttctttcgtaagccgaagcttctttatcgtatacaaattcgacaagttctgtcattttccttgttcgacaatctgacaaacttgtttgcttccgatatcaagatcacttctgcttaattaggtctgtcctaaaaatacaggctgtgcggaaagctcggcgagaccacaaacatgcgccccgcctcgctcatcaattattcaaaatatgttggtcggccagcgtaaccgacagattcatttttcaatcagggcatttcactcgtcatgtcaaagccctctgcttcaacaactccacataagcattttcacttacatgtcagtgaagagatccactgctcacgtctgacctataacagctgtcagaaatgtggcaaagatgatacagctccactctgttatattttaacgcattatagacggaaagagtacagtttttttcatgacatcaaatattcctcttggtgtcactcgaatatacggcaaatgtgtactttggaaaaagacaagtgtatcaattgggcaatcaaacggatagcctcgctcaatgagcagctcgcgtaaggtttgtatctgctgaagaacagtctcaaacggttcagcagatgcacagcctgataattgcagcggaatttcgtgcaaaattttcccgttctctgtgaggacgatccccccgccgatttctttcattcgcttatgtgccagcatcatatcttctttatttttcccgatcaccaaaatgtcacccgtgagcgaaaatgagctgacaaacccttgcactttgtttgcaaaccctttgagcatcgtattcacacgccactcgccttttcggtcaatcaggctaaagaaactttgatcatgatcacatgacagctgattcacagagttatcaatctccactgtataaggctccatgatgactgcatttctcattttgacacctagcggcatggaaaattgcaaatcactcgacgttagatcgtagcctagatctaatggaacaagcccgccattttcccattttgtttcatgaaattgatgctggttctcgccatctaatttgaggataacccctttagatatgaccgtttcaggatttggattcattgggtcatctaacacattcaaagaagccaatcggccaggaccgacaacacctaataggtcatcaatttgatagtatttcgcaatgttaaaggtcgccatattgtatgcatcgatgataggtacgccttcttcaagggcaattgaaatcaaacgattaatcataccctcctcataaaaatgaggcgctgctccatctgttgtatagaagaagtgatcatagtgtctaaaatcacgctcgtgcagctctcttagaatgttcactaaatctgggcggatggaagaatgacgaagtgagacatggtagccaagggacaagcgttttagcacatcgtctgcattcatcgcttcatgatcgctgtccgcgccaaacagcttcatttttgttagcgttttctcagaagctccggggaaatgcccttcaattcgtttccgctgcttcttcgtttcttgcatgcaatataaaatgagatcatcaccgtccatcaatcttggccagcttgttaattcgccgccttgaagaacgtcaggatgatcaatccattccttgcgatagttgataggaagcatctcatcttcatatctgacctcggtttgaagatcgtatctagaccaccagaaatactgaaatggctgctgttttaattcacatagagtggaaagcgctttcttttcattactctgcaaaagaagaaataagttatcactgaccattgttgttgtgccaaattgagacacatattctgcaagtgattggggattataaatatggaacggatgcgcgtgaggctctatatacccaggcacaatgtatttcccttcacaatcaatcacacgtttagctgatttattttgaggaagctctgctccgacataaacaattcgatcatcatgtatccaaatatttgccttcacccattgttttaaaaacgggtttagcacgagtccattcgttaaaaggagtgttggaactatttttgagtcgactacatcgatttgtgtgcggatgtcattgtttctccaattaaaagtacgttcggacattcacatactctccttcatttgtattagccctatcgtaacataacgaaccacgttacgcattaatgaaacgttacaatttcttgaaatcacacttaaaatattttaaaaaggagatttaccttcaatgaaacctaatctcggcttaatggaagcgctcattcgaattgcctgtggaatgacaatatgtactgtggctggttctttatatgctagaaaaccatggagtaacatgctgcttttcagcatcatgtgcggcgggatgaaactggcatctggcattcttcgcttttgcccagtgacgtatatgtgtgagcagcaggacacacataaagagaaggctgattgaaacagccttcttttttatgatttccacctctgtcatcactctgctgcttcacaccattccaccatcgtacctgcgataatttctgcggcttcaataacatgctcaatgtcgatggattcattcggaaaatgggcaagctccgttgttccaggtccaaatacgatgatcgggatacctgccgcctgtgacagtaatccgccgtctgttccccaaggagcggcttcgatctttggcggctccttcttgaccgcttcatattgttccttcaatagatctaaaagtggatggtcagtatcaattgagcctggaagccatcttgcaccaaaccattcgacctcgacaggatgctctttgaaccattcatccttttccccaagtcccatcatccaattttctaattccttctctgcctgctcaaccgtctcccctggcatcacaccaagtctgccctccattgtgaccagatccgctacagaggacggccagtcaccgccttgaattttccctatgttgatagggattggaatcgggatatgctgaaataacggctcggtgatgcgctgatttcgttcttcttcaagtgctgctatatgcgaaagaacgatcatacttttttcaatagcggaaacgccgtgatatcttgttcctccatgagctgcccttcctttaatatgcagtctgaaccacttagatccctgctgaatcggaaagattttcatatgacttggttctggaatgatggccgcatctgctgtataccctctcagtatggctgcaagggtgcctgcaccgccgctctcttcttcgacgacactatgaaacacgacatctcctttcagcggaatctggagcgcatgcagtgcttctagtgcaaagagtaaagaaacgtttccgcctttcatatctgttgccccgcgtccataaagtctcccgtttatgatatgcccgctgtagggtggatatgtccattgtttcgtatctcctgctggcacaacatcgacgtgcccatttagtaaaatggatttgccgcccccttttcccttcaatcgtccggcgacattgggactttctttaaaggaacgcctcggggaatagaaatacggatgttcgagcaggtcttctccgccaatgtcccatacatctacatcaaaaccaatggcggacagcttatttgctacgatttgctgcacaccttgttcttttccttgtgtgctctcacattgcaccatttgctgaagaagcgcaatcgcttcatcttggtgctctctcatccagcttctgatacgtgtgattggctgcaagtcattcatcctttctacacaacagatttgacatcaggcgctaaaattaaaggtgcctctgtcgcccttatgacatcttccggctgatacggcggcatgacttcacgtaaaatgagcagctgcgatttgacctcaatgactgccatatccgtaatgatcagatccacacaagacttagcagttaaaggaagtgtacaggctgatttcacctttgactcaccgtgtttatcgaggtggctcatcaccaccacaacttttttcgccttttgcgcaagctcaatcgctccgcccatcccaggtactcgtttacctggcacaatccaattcgcaagatcgccctgactgcttacttcaagtgcacctaaaatggtcatatccagcatgccttttcgaatgatgccaaaagcagtcgtgctgtccatgtatgagccgccttttgttaacgtaataggaaagccgctggcattgcacaaattaggatcttcttccccttgtactggtgaggcgcctgcccccataatgccgttttcagcatgcagccatacgttgtaatgcgctggaatgtaatcagccgcaagggttgggatgccgatcccaagattgacgatcatgccatcttcaatttcctgcgccgcccgtctggctatgcggtgtcttatatcgttgtctcccatgcccatgtccagttcactccttttgattgcacaatctggttcacaaatacgcctggtgtcacgatttcctctggatgaagactgcctacaggcacaatctcttccacttccgcaatggtccagtctccagccatcgccacaatcgggtttgtattccgtgcacttttatcaaatatcagatttcctgcttcgtctgctttgagggcattcacaatggcaatatccgctgtcagcgcaggctcaaggatataggtctttccgtttaacggcacgagctgcttctcatcgagattgaggctatccatgccgacatctgtcacaatgcctgccaagcccatcccgcctgctcgtattttttctgctagaatgccctgcgggtaaaaatgaacgtctagtgtacctgcctgcattttctgtccggctattggatttgagccaatatgagaagcaatgatcttcttgactcttccttctgtgatcagccggccaacacctatttgcgggaagcctgcatcgtttccgatcaatgtcagatctttgatattggcttctaaaatggcctcgatcaatgatggcggcgaccctacgccgccaaacccgccgaacatgatggtcattccgtccctaaaatgcgtgatcacttcatctacattcactgttttgttcatcatctttcctccctacatcgcagatgggaaaaaccccctgttaatgacttcttgttcgacctgcgtgattgtctgctcaaataattgaatgagttcatccatctcctgctgcgtgatagaaagcggcggtgcaatcatgaccgctgcacctcctactccatcctcgccagcgcttgctgggtatacgagcaagccgttttgcttggctgtctcaacgactaaatgcgtcatttgagcatgggcaggaaatggggttttcgataagcggtctgcgacaaactcgatgccaatgagcagtccctttcctctcacatctcctatgatgaaatggtttgtttgtaaatcctttaatgcattcattaaatagcggccagacagatccgctcgttcaggaagctgatgttttttcatatatcgaataacagccagtgagacggctgctgaaagcggattgccgctataggtatgacctgccatcacagatccggaaccgctcagaatcggcgcgatgacatgatctgctgagacggctgccgcaatcggcgaatagccagcactcatccctttgccgagaaccataatatctggaacaactccccaatgctccatcgcaaacattttcccagttcgtccaaagcctgtcatgacttcatctgcaatcattaaaatattgttttcctcacagacacgtttcatggcttcaaaatatccgtctggcggtactagcgccgctcccgatgctccgacaatcggctctgcaataaaagcggcaatcctctcttttcctatacgctgaatgacggtattaaattcctggacataccattcaacctgcttgccctcttccttcggcagccatgaacgatagctatatggcggagacagcactggattcttttcgagcaatggttcaaagcgctctctccttgcaatatgtcctgacatcgacagtgcaccgagggtgatgccgtgataactcatccatcgtgagataatgtgattcttctcagcctttccctgctcctgccaatgctgaatagcaattttcatagccgtttccgttgcctctgaaccacttccgacaaaaaaagaccagttcaggttacctggacaaagcgtactcaattcataagcaagttcttctgctggttcatttgtgaattgtgatctgtacgtaaagctcactttttccgcttgctcagtcatggcatcaatgatttcacgtatgccatgtccaatacttgccgtgacagcccccgatgagccatctatatatttttttccatcccgatcatataaatatattccctctcctttcacagccacaggataatgctgattcaatatcggtttgattaagtaatcccggatctccactttgccattcctccctctctcgtcagcagctgcctctttctttttcatgaatcgcaagaaaattttgtatacttgttataagattagcttaatcaagagggcagtcatcctccattcgccacatgcccgaatttcagacgcattttttatacatcgtgtataagagtgttcaaaaggaggtcatgagcctatggcgattctcgtcaaagatgcactttcgctcgatatcatgaaaggaacaaagctgcttgctggagaaaatggactggaccgactcattgagtgggtgaccatcgttgaaattatcgaagacacgtcgaggctttccgatggggaattgctcgtcacaaccggattcggactagcggacaatcaagaaagaagcgaccggcttgaggaattgattcaatctcaaaggctatcagccatcgctatttataaaggtgtgtacttaagtgacattccagcttcactcattcaagcggcgaaaaacagcggcattccgctcattgagattccgccgcacatcaacttctcagatattacaaaagccgtcttagaacaaatcgtgagtagtcagcttcatcagcttaaatattcatccgcgattcatcaaagactgacccaattaaatgtaaggaataaaaatgtaacgcaaattacagaggaactggcacatctcactgcagcgaacattgtcgttcttgatgtctttttacatcaaacagcggctcatctcatcaaagatgaagtgacatactctcctgcttttggctttttgacagatcatgaaccaattgataccatgccccttctcaagcaggcagaggagaaagggcggctcgtctatgacacgtgcggagcgttcgtcctcgccgcatgtccagtgattgcgatgggtgatatttttgggtttattgtgtctttaaagaaaaaggatacgtggcatcatctcgacgcgattgccatcgagcatgccggggcagtgtatgcgattgaatggttgaagcaaaaagccattcaagatacagaaaaccaaatgcagggacatttgttagatgatattttgcagcagcaatatacagaagaaagctacgtggtcgaacaagcaacaaagctgcaatatgatatgagcgatgagcaggtggtgatctactttcaattccagcatcagcacacacagctcgatcaccaaatgatgcagcgtctatcgcaattactcacttcgatctttgaacgcagacatattccttttttgctaaagacaaggctcgattccatttttgtcctaacaccagcaggaaaaaaagcgtttcaagaagcggagtggtatcgcgcagcagaggaatgccggagcacttggtcttattttttccccgtccatccgattgtcattggtatcgggagagcctatgaccagatcagtctctttgcaaaaagcgcgaaggaagcgcagtatgcagctaggcttcttccgcttttaaaaacagacgagagcatcattcattatcaaaagctcggcttatatgggatgcttcttgaaatgaatgaagcgggtatgaatttgcatgatttttacgtggagctgttaagtccgttgctatatacgaaaaagcaaggggctgacctgattcatacactcgaagtgtatttggcgcacaatgaaaatattcaaaaatctgcgggagaattatttattcatagacatacgttaagctaccggctgaaacaaattgaaacgagaacaggctgcagcctcaaatccactgatgatcggatgaagctgcagcttagtatcatggcgtaccgcctatctggtctgcttgatcagatgagaaccatttcatgattcatttggcgttttaacccatagattcatatcttcaattttgtcaaaaatatagcagttgttttgaaagcgaccggtgtacgtatatccgagctgataaaatacttgattcattccataggacagtgcacgagcaagagaataaaagacatagatatgcatcgactggagttctttttcaagggctagaatcaaatgatgcatgaatcctagttttctatatgaaggaagggtcgcacagtctgttaattctgcatgaccatacggcgcattgatctcagcggatgctgcactcacaatgtgtccgtcatgttcaacaacataaaaaatggtcccttcctccattaccttttgaatataatctgactcgttcattggcgtagggtacgtttcaaagacggtatcatagagctttgccagcttgtgaatatcctttggatcggcttttctcatcacatactcatcctgccatgtgccttggtcttttttgattacttttgcttgaatggatgcgacgatctcatcttcctgcagccaatacgaactgttcattcgatcctcagtgagaaaaagcgacataccgtaagcgtcacttccaaggaaataatgagaaaacaccccttcaagccgaaagcctttttctaaaaaaagcggcacatgctcacgtcttactttcacaataaccttagaagccttacagtccgtcgcttcctttagaaccgactgaatcacatcccgcaccctgccgctgtagtcatccaaacggattcgctcattaaatgaatcaatacagatcgaggcagaaaaacgctcgttcgcaagttccttcaattgcaccatacactcattcctctctaatgaattagttaataaagaatgtccaaattagaaatgacgaaatagcgatgccagaaaaaattgaaagtatcatatataactaatggctgaagcttttttcattttattgtgcttaatggcaatcaacatgatgttatttatagttatgagaaataaaataagtatgacgattgcaaagataataaatgctttgatttccatgtttcctcccaatatctattcgtgatcccatactacttcttcatattcaatcggcatcccttctcatgaacaaaaaacacctttccatctcatcagatagaaaggtgttttgattaaacggattttcccgcagccttcagcgcacgggcgccaatgtcacggcgataaaatagacctggttgaatgatttcttcaaccgcttcatacactcttgatcttgccgcttcaaatgtgtcgtcaaatgcggtcacatttgctacacggccgccatttgtgacgaattgatcgttttctttttttgttcctgcatggaaggtcacgacatcagacaccgtcgtttgcaaagcgccgattggcgtaccttttgcgtagtcctcagggtatccttctgaagcaagaaccacactcacagcggcagtgtctttccactgtaagtccacatcttttccgtctagaatatcgaggaaaacttgaactagatctgattcaagacgaggaagaaccacctgcgtttcaggatcgccaaagcgtgcgttgaactcaatgacttttgagccttctggtgtcagcattaagcctgcatataaaatgcctgtaaacggacgctcttcctgcaccattgcgcgagccgccggtttgacgacatcttccaccgctttttggacgacttcatctgaaatttgcggaactggtgaataagcgcccatcccgccagtattcggtcctttgtcatcttcaaatgcacgtttgtgatcttgcgcgatcaccattgggtacaccttttctccattgacaaaggccatcaatgaaaattcctcacctgttaaaaattcctcgatgacgacagatgcactcgcatcgccaaacttttcatcctctaaaaagtcatgcagacagctgatcgcctcttcaagtgtcattgcgactgtcacgccttttcctgctgcgagaccatcggctttaatgacaatcggcgcacccttttcttccacatatgccttcgctttttcaaacgatgtgaaggtcgcataagcggcggttgggatctcataatttttcattaagtcttttgcaaattcctttgagccttcaatgactgcggcttttgcatttggaccaaatacctttagacctgcctcttcaaatgcatcgacgacacctgcaattaaaggaacctctggaccgacaatcgttaaaccgatttcattgtcttttgcaaaacgaattaatgcctcatgatcaccttcgtcgattgggacaagcttcgcagcatctgtcattccatcattgccgggtgcgacaaatacttggctgacaagttcactttggttcactttccatgcgatggtatgctctcttccgcctctgccgataattaatacgttcacactgtcatccccttaatgtttgaaatgtctaacgccagtgaagaccatggcgatgccgtattcatctgctttttggattgattcttcatcacgaatggaaccacctggctggatgatcgctgtgacgcctgcctttgcagcagcttccactgtatcgcccattgggaagaacgcatcagagcctagtgcgcttcctttcgctttttcacctgcttgctcaatcgcaatatttgctgagccgacgcggttcatctgaccagcgccgatgcctgctgtcatttgatctttagcgagaacaatcgcatttgatttcacatgcttgacgactttccatgcaagctttaagtctttccattcgtcttctgtaggttctcttttcgttggaatagagatcgttgcttcctctaagccatacgtatcaatatcctgcacaagcagtccgccatgaacacttgtcatctgcttttcttttttcccaagatctgcttctacatctaatgttaatagacgaaggttctttttcgctgttaacacgtcaagcgcttcttggctaaacgatggagcgatgacgatttctaagaaaatcgtatgcagcacctcggccgtttgcttgtctacttcacggttaagcgccacaatgccgccaaaaatagaagtttcgtctgctttgaatgctcggtcaaatgcttctgcaatcgtttctcctgtaccaacgccacacgggttcatatgcttcacagcaacagccgctggctccgtaaattcacgtacgatttgaagagctgcatctgcgtctttaatgttgttgtaggaaagttcttttccatgtaattgcgttgcagtagctaaagaacctttgcttggaagagcattttcatagaaagtcgccgcttggtgcgggttttctccataacgaagggattgttttttctcaaacgtgacggtgaactgctctggctctgtttcgccaacaaaattcgttaaataatccgcaatgagggcatcgtaagcagctgtatgacggaataccttcgccgcaagctcacgttttttctcaagtgacacgccgccttctttgatttgctgaacgactgtatcataatcacgagggtcgacaatcactgtgacgtcttggtggtttttcgatgccgcacgaagcattcccggtccgccaatatcaatgttttcaatggcttcttcatacgttacatcgtcttttgagatcgtctctttgaaaggatagagattcacgacaacaagatcaatcggctgaatgccatgcttttcaatctgtgccatatgctcatcgttttctctcactgccaataatccaccatgaatgttcggatggagcgttttgagtcgtccgtccatgatttcagggaatccagtgacttcagaaatcccaatgacatcaatgccattctcttgaagaagcttatgagtacctccagttgaaatgacttcaacaccaagttctgttaattctttcacaaaaggtacaagattcgttttatcggaaacactgattaatgcgcgtttgatcgtcatgccttcgtcacctcattaagataattctaaaagtgatttgatcacttttggatatagtgtgtgttctagttcatgcattcttttttcaatcgattcaagctcttcaccttgttcaatataaatcgcggcttggtcaataatcggacctgtatccatcccttcatcgacaaaatggacagtgatgcctgccactttgacgcctgcttgataggcttgtccgatggcatcaagacctggaaaggctggcagcaaggatgggtggatattcacgattttccctctgtatgcttcaagtaatgtcgggccgatcagtctcatgtaccccgcaaggaaaacccattctacttcatgaagcctcagttggtcgatgatcgtttgttcaaaagcggctttatttggaaaagccttcggggtaaaagcaaaggagggaatgccttctttctcagcacgctccagcacctttgcacccggtttatcacaaatcacaatggcggcctcagcctgccacttttcttgttttaacgtatctataatggcttgaaagttcgtcccgcttccagaggcgaagatcgcaaacttcttcatgagaggcttccaccgccgaatgtgacaccttctcctttttgaacacgtccgatgagaaatgctttctctccatcctgttcaagctctctaatcacattaacaagatcgtcctcttttacagctaagacaaagccaatgcccatattaaacacgttgaacatctcttctgcctttaactgacctttttcttgaataaaggaaaaaatgggtggtactggccatgagccgttatcaatctcaacgccaagaccttcaggcagcatacgtggtaaattctcaataaaaccgccgcctgttacatgtgccatgccgtcaactttgccggcttttacttgtttgagaacgggcttcacataaatttttgtcggttcaagaagctcttcaccgagcggtcttgtaaaaggtgcatacgtttgatgcagatcaagaccagcgtcttccagcaagactttacgaacgagagagtatccattgctatgaattccgcttgagctgagtccaataagcaaatgtccctctttgatgctgtttcctgtcacgatttcgtccttttcaacgacacctaccgaaaaaccagcaatatcatattcttcttctgtgtaaagacctggcatttcggctgtctcaccgccgacaagtgctgaaccagactgctcacatccgtcagccacacctttgacaatggattcaatttttaccggatctgcttttccaacggctaagtaatctaagaaaaagagcggttctgccccctgtgcaagcacatcgttgacacacatggccacggcatcgacgccgatcgtatcgtgtttattcattaaaaaggcaagctttaatttcgttccgacaccatctgttcctgaaacaagaacgggctttttgtatggcagctcagatagatcaaacataccgccaaatccacctagagcgcccataacacctgctcgttttgtacgttcaacgtgtgttttcattcgtttgacggcttcgtaccctgcttcgatgtcgacaccggcgtttttatatgcttctgacatcccattcactccttttagctgctgctttccatgtattttcggcagaatgaaagagcagcatatcaactcatcttgactgctgctcctttattcgattatttcgtcaggaccgtttccttcacatgcggaagaaccgtatcttcatatatttcagtcgggtatttcccagtaaagcatgccaaacactgaccgcgctgcggatcatcatacttcctgccaatcccgtccattaaaccgtctacagataaaaatgcaatggagtctgcaccgatttcctgtctaatttcttccactgaatgagaagaagcaatcagctcttcgtgtgtggatgtatcaattccataaaaacatggatgtgcgattggcggtgaactaatacgtacatggacttccgtcgcacccgcttctcttagcatcgtgacaattctgcgacttgttgtcccgcgtacgatggaatcatccaccatcacgacacgctttccttcgactacaccgcgtacagcagacagtttcatccgtacgccctgctcacgcaatgcttgagacggctggataaatgtccggccgacataacgatttttaatcaatccgagctcatacggaatacctgttgcttcggcatatccaatcgctgcagaaatactggaatctggtacacctgtcacaacatctgcttcgacatgtgcttcctcagcaagctttttgccaagattctttctcgcactatgcacattgataccgttaatattgctgtcaggtcttgagaaataaatgtattccatgctgcacatgctgcggttaatgttcatcgagaagcgctcagatttgaggccttcatcattaataatcagcatttcgccaggctccacatcacgtaaatacgtggcaccgacaacatcaaatgcacaagtttcagaagcgacaacataagcatccccaagcataccaagtgaaagcgggcgtaaaccgttcggatcaagcgccacgatcatttctgtttccgtcatgattaagaaagcataggctcccttaagcatggacagtgcatttttgatctgctcttttaattccatatgcccgctgcgcttaattaaatgagccagcacttcggtatcagaagaggtctgaaaaatactcccttggttttctagctgctgctttaactgcgttgcattcactaagtttccattatgagcaagggcaaggctgccattgttttgcgaacggaagaagaggggctgcacattttcaaagccgcctccacctgctgtcgcataccgaacgtgtccaatcgcaccttttcctttcaaatcctttagctcaccgttttgaaagacttccgtaatcagtccaaggcctttgtgtgacgtcaggttctcaccatctgttgcaatgattcccgcaccttcttgtcctcggtgctgaaggctatgcaatccgtaatatgtgatttgcggggcttcttcgtgtccccaaaccccaaagacaccacactcttcatttaagcctctgatttcagcaagcatgggatcgctcctttccatgcacgttcaagctcgttgaccgctgcatgaatccattgttgtccttcttgatttttgacagtaaacacaccatcatttgtcaccgttccgacttctttcgcatctttgacagccgcagcaaacgcttcgcggtgctccggtttcactgtgacaacaaaacgtgactgtgtttcactgaataatgaagcttcgctgtttaaatcgatttggatatctgcaccaagtccgtcagttccaaatgtactttcagcaagtgctacaccaagtccaccttcagacacatcgtgtgctgattgaacgagaccgttttgaatcgcggctagcagagcttcctgacgcgctagctctacgttcaaatcaatttctggtgcttttccgtaaatacggccttctgtcatcttttgaagctcactgcctgcaaattcttcttttgtctcaccaatgacgaaaatcacatcgccagcctgcttgaacgattgagtcgtaatatgagcagtatcttcaaccaaaccaaccatcccaataactggagttgggtaaatcgctgttccatttgattcgttatataaagagacgttcccaccgatcactggtgtgcttagcgtgcggcaagcttcgctaatcccgtcagcagacttttcaatttgccagaaaatttctggtttctctgggttaccgaagtttaggttatctgtcactgctagcggacgagcgcctgagcagacaatgttacgtgctgcttctgcgacggcgattttcccgccgacctctggatcaaggtagagatagcgcgcgttacaatctgttgtcatcgctagggcttttttcgttccgcggattcttaaaacgccagcatcagagcccggtgcaacgacggtatttgtccgaaccatgtagtcatactgatcatagacccattctttacttgcaatcgttggctgctgaaggagctgctttaatgtctgtgctgcatctgtgatcgctggagcttccacttttgtttctaaaaactcacgatagtatgcaggctcacttgacggcttatgataaaccggtgcttcttctgcaagagcgtcaacaggaagctcacacaccacttcaccttgatggagtaaacgaagcattttatcgtctgtcacatgaccgactgataccgcttcaagatcgtatttttcgaaaatatcaatgatttcttgctcacggcctttttcaatgactagaagcattctctcttgtgattcagacagcatcatttcgtatgcggacatgcctgtttcacgctgcggaatgaggtctaaattcatctcaatcccagatcctgctttactcgccatttccgcacttgagcttgttaagccagccgctcccatatcttgaattccaacgagcgcatcgtttttgatgacttcaaggcacgcttcaagcaaaagtttttccatgaatggatcaccgacttgaaccgctgaacgtttttcttctgattcatcagaaaattcttcagacgcaaatgttgcaccgtgaataccgtcacgtcccgttttagcaccaacatacatcaccgtgttgccgacaccttttgcctgcccttttttgatgtcctcatgattgattaaaccaacacacatcgcattcacgagcggattgccttcatagctttgatcaaaatgaacttctccgccgactgtaggaattccgatacagtttccatagcctgcgatccctgccactacttcttcaaacaagtacttcacgcgcggtgaagtcagttcaccaaaacgaagagagtttagtacagcaattggacgcgcacccatggagaatacatcacggataattccgccgacaccagtagctgctccttgatacggttcaatcgcagatggatggttatgtgattcgattttaaatacaaccgcttggttgtctccaatatcaacgattccagcgccttcccctggaccttgaagaacatgctctccttttgtcgggaatttgcttaaaacaggctttgagtttttataactgcaatgctctgaccacatgacagaaaaaatacccgtttctgtgtagtttggcagcctgccaataatggattcgattaaagcgaattcttcatcactcaatcccatttgctgatacaatttctcttctttaatttgcttgtgacttggttcaagcagtagtgacatgagtgtccctccaatttttcacgatagattgaaacaatttaagtccgtctgcgctgcctagtaatgaatccaccgcgcgctcagggtgcggcatcatgccgagtacattgccctcttcattcgtaatacctgcaattcgattgacactgccgttaatatcgtctccgtaagtgaaagcgatttggttattttcaataagcttcgctaaagtgtcttcatcacagtagaagtttccttcaccgtgcgctacaggaaccgaaatggattcgccttttagatagccgcttgtaaattgcgtttcgttgttctctacaatgagttcaactggacgacagataaattttaagtctttatttcgtctcatcgcacctggaagaatgccaagctcctgaagaatttggaacccgttacaaacaccaagaacaggctttccttccgcagctgcttttttcaccgccggcatgatgtttgaaaagcgagcaatcgcaccgcatcttaagtaatccccataagagaaaccgcctggtacgagtacaccgtcaaatccgtctagactcgtttcgtcgtgccatacatattcaacttgttcacctaactcatcttgaatcgcatggtacatatcgatatcacagttagagccaggcaagacgatcactgcaaacttcactgtgcgacaacctcctccacctcatagcggtaatcttcaatcaccgtgttggccagtaatttttcgcacatttctttgacgactgtgtctaaatcacgatctgatttttcaatgacaagctccatgtattttccgatacggacatcctttacttcctgataagacatgctgtgcaaggcgtgctgcacggcacttccttgtggatcaagaacactctcttttaagctgacaaaaattttcactttatacatgtttatggcctccaagtcttttgaaaatttcttcgtatgcatttgttaagccgcccaggtttcgtctgaacacgtctttatcaagcttttcgtttgtctctttgtcccaaagcctgcacgtatcaggtgaaatctcatcagctagcaaaatacgattctcgtgatctattccgaattcaagcttgaaatcaattaaattcacatggcagtctgagaagatttgctttaactcttcattgacttgtcttgtgatctgtttcatttcctcgacctgctctggtgtcgctgcatctaaaatgcgaatatgatcttctgtaatgagcggatcgccgagtgcatcatctttgtagtaaaactcgatcaatggtgtatccagttttgttccctctggaatgccaaggcgctttgacatactgcctgccaccacatttcgcacaaccacttcaagcggcacaatctgtaccttttgaatgagctgctctgtttcagaaaggcgtttcacaaagtgattgttgatccctttctcatgcagcatttgaaagattaagcttgaaatttcgttgttcagtctgcctttgccttcgatttcagctttcttttcgccgttaaatgctgtcgctgagtctttatattcaacatataaaatttgctcgtcatcggtctgatagatttttttcgctttgccttcgtagagaagttcttgtttcacagtcattcaggttggcctcctaatttgaatgttggcaattttcaggattgggcacctgacaagcaggtggcccttttcttacacaagacctagacgttcgaaaatcatatcgacatttttcaagtgatagttgtaatcgaagcagtcagcgatttgttcaggtgttaagcgtgatgtgattttttcctccgcttctactaatgaacggaatggcacttgcttctcccacgcttccattgcctttggctgaaccgtatcatatgcctcttcacgtgccatgcctgtatcgattaatgcaagaagaacacgctgtgagtaaatcaagccaagtgtgcggtccatgttgcgtttcatgttctcagggaagaccgtcaagtttttcacaatgtttgagaaacggtttagcatgtagttcagtgcaatcgttgcatctggtaaaatgatgcgctcagcagacgaatgagaaatatcacgctcatgccaaagtggtacattttcataagctgtcagcatatatccacggatgacgcgggcaattcccgtcatattttcagaaccgattgggttccgtttatgcggcattgctgatgatcccttttgtccttttgcgaagaactcttctacttcacgtgtttcactcttttgaagaccacggatttcaacagcaaatttctcaatgcttgttgcgacgagtgcaagagtagccatgtaatcggcatgacgatcacgctgcaaggtttgggtggagattggtgcagctttgatgccaagcttctcacagacatattgttcaacaaacgggtcgatgttcgcatatgtgccaacagccccagaaattttcccaaattcgataccggcttttgcttgtttaaaacgttctaggttacgcttcatttcttcgtaccaaagaccaagcttcagaccaaatgttgtcggttcagcgtgtacaccgtgtgtacgtcccatcatgacagtgtatttatgctctttcgctttttcttttaggatgtcaacaaatctctcaatgtccttgagcaagatatcgtttgcctgctttaatagatatgaaagcgccgtatccactacgtctgtagatgttagcccgtaatgaacccactttctttcttctcctagagattcagatacagcacgcgtaaaggcaaccacgtcatggcgcgtgtcttgttcaatctctaaaatacgatcaatatcaaagcttgcattcttacgcatagtcacaacgtcttcttttggaataacaccaagctctgcccaagcttcacaagcgagaatttctacttcaagccatgcattaaatttgttttcctctgtccagattgctgacatttctggtcgtgcgtaacgttcgatcatttcccgtttcctccatctctttcagtccatatctttgtgatgtttgtcatccattcatcatcaagctgtttcataaatgtcatgtgccccattttgcggccggcttttacttcatgctttccatatagataaagcttcgcttctttgagaagctcaggatgctctattgggatatctacttcatcgcctaataagttcaccatcatgccctctgacaaaaggactgtgccgccaagcggtaaaccgcatatcgcgcgaacgtgctgttcaaactggctcgtctcacataaatcgagcgtataatgaccagaattatgcgggcgaggcgccagttcattgacgagcagctctccttcgtttgtcaggaacagttctacagcaagtgtacccactagcccaagcttttcagccagtgtcgttgccagcacttttgccttctcctgaatgctttcatcaactcttgcaggcacaatgctctggaacaaaatgttgtgcttatgaatgttctcagcgactgggaataccgcaatctccccatgaatagaacgagtgacgatcaccgagagctccatttgaaatgggacccagctttctaaaatacaagttccatgtgtgagcaattcagatgcttcgtgaagctgtcctgtttccttgatcacatactgcccttttccgtcgtagccgcctctgcatgttttcaaaacggctggcaaaccaagtacagttactgcgtcttccagctcttttccatcatgaacgatgcgataaggcgcaacttcacagcctgcatctacaatcccttttttctctgtttcacgattttgcgttaaaagaagaagttcacttccttgcggtaaattggcttcttccttcaattgattgagtgcatcgtaatcaatattttcaaattcatatgtcacgacatcgctgatttctgcgagctgtctgattccatccaggtcactatatgcagctgtgatttctgtatcagcaacctgtccacagggagattgtgcgactgggtctaatacagctgcccggtaccccatttgctttgcactgacggccatatatctgccaagctgtcctccgccgataataccgatggttgcgtttggaaaaatggtctgcttagccaagctgatcactgctttctagtacagtctgttttgtttgctctcttctttcctcaaggcgagcagcgattgtttcatcaaaagctgaaatcatttgtgctgctagaaggcctgcatttgttgcaccggctttgccaatcgccactgtcgcaactggtacaccgcctggcatttgaacgatggataataaggaatccagcccatttagtgcttttgattgtacgggcacaccaatgaccggcagtgtcgtttttgctgcgaccatccccggtaaatgtgctgcgcctccagcaccggcaatgatgacttttagtcctttacctcttgcttctgccgcatattcaaacatcaagtcaggtgtccggtgtgcggatacgacctgtttttcatacggaatgtctaattcctctaagatatcgcacgcatttttcattgtttcccaatcagatgtacttcccatgatgacacctacaagcggcttcattttgtccccacctttaagctgatattcgattttgtatcgtttgacacgcttcccaaacctaagcagcttgtcaaacgccgaacaaaaaggcccgatttgcattgcattgttaggaagcaacacaaaccgggccatggtaagcgctgttcgcttttgaaacgccatgtcagttttgttcactatcctgcatagtccagtcatttacggtaactgggtagaaacttatgggccatattcccaagattatatgaggttcgtgttttgaattcatgtttatcttaacaacggatgttcatgatgtcaacggatttatcgaacaatctatgaagtcgtcgttttaatgttcggatttagactatttttccttcaaatacgatttttttcccaatcggaatgatctgaatcgacccattttccttcttttcctgaaaaatgggctcctccattcgtcggacaggcgagtagccttccgctgccatctgggacaacacttgatcgatcgtcatgttgtcttccacatagaatttcttcttctttggttttgcggtcattctttaattctccttttcttcacagccttcacccagaagccgccatgaatcgatttgggctcatatgaaatgataaatgcctttgaatccagcgttttaatcgtttcatataattgcagttcatattttctcggtgttaaaatttgcaatgctgtccggtctccttcaagaccgcctgctacccagctggtgacaccatatcctttttctctcaattgtcttgggagatcgacatctaattcttttgtgatcacgttaacagttgtgtagccaagtgccagcttctcttcaattttcatcccgacaatgatccccatcccataacctaacgcatacgcaatgacattttggatttgatctaagttatcaagtacgatacttaatccaatcacataaatcagcatttcaatcgtaccagcaaaagctgctgcgtaccgtctgcctttcattgttaaaatcaaacgcatggtggaaaaagagacatagacaatattaatcactaaaatgatcaaaaccatggtgaacgcattggataaaagttgttgaagcacgattcgaaccccctgcactaaaaaatcaaataaagcaccccatattctactagagaacataccttgatacaatcaaatttgcgcgagaaaaacacatatatctttcgacaagaacggtggtctttgttaccaagagtttacccgttttttcctcttctcaacatgaaaacctcctttttcaaaaaaggaggtttcagattgttgacaaagggctaaaatgatcttgattttagccctttgtctcctattcagcgtgatagaaaacctttgcagtctaggaaggacgagtactggcgcggagcgaatttgacattcgtgagcaccagcacgcaggactgacaccgaatgcgagggtttgtctacacgctgaacctcctttttcataaaaggaggttttcagtgtgtgtattatccaaatcgaacaggcacaagtgaaggaatcaaatactctccgacaatgccccagagcagtgcaatgatgacaagctccaccaataaaaagatccagccggcatacatcaaatcaccacgcaccgcttcatgcttcgattgaatcgagcgaaacagcacgaccgcaatcaactgaagaccaaaaaacatcatcacagataaaatgaccgtcacatatggaatattcagcatggcaaatacaagccaaaggatcgataaaaccaaaaccggtacaagtgcggcaccaaacttcatgatcacttctttcagtgatatgtttccttttaacatgtattttccgagtaaccagacggtcagcatcatcaatgtgagcagaatgagtgtaaagaccgctaccctcaaaaaggcgtcaccaaaagagtaatgaatgccaaagcctaataaacgagtctttgacgcctttaattgaacatagttgcctaaagcaaaaaacacgctgaataacacaatcgagatccaggcgtacttcatccgtaatgtttccgcttgattgatggcccgactcggtgattttaacatcgcaagtccatatgagccatagcgcttaaacgcgcctcctacaccttgcagcatgcgctgaatggtagaacgctcatcacccgctgctgtttttactttcgacgttcttccacgttttgcggcgcttctgctaagacgggattgtctcgtttcttgatctattgatggctcttcattttttacgtctgatgtactttgctcttcatctttttctaacatctcatatcaactcctatccagcacaatccttacaggctcatacgaatgacctgtaaggatgactcctcttaaagtagcggagtctctctgttcagtcaagattccttgacgttcatacgaatagacggctaaagggcatcagaggttttaaaatggcaagaaaattagggcaaaacaaaaaaacagcagcttccatgagctgctgtttcaggcgaaccattaatgatttaagaaagcaaagtagagaataaagatcacaaacaatccgtacataatcggatgtatttcttttgctttccctttaaagatcatcgtaatcgggtagaaaataaagccaaccgcaatccctgttgcaatactgtatgtgagtggcatcataatcatcgttaagaacgctggtacggcaatttcaaaacgatcccatgcaatcttcgcaagcggagcgaccatcagtgcacccacaatgattaaagcaggtgctgtcacattctttgtaacgatggataaaagcggcgaaaagaacatcgcaagcaagaagaaaatccctgtcacgacagctgcaaatccagaacgtgcaccagcagcaacacctgagctagattcaacataagatgttgtcgtcgatgttccgagaatagaacctacaacgattgaagatgaatccgctagaagtgctcttcctgcacgcggcagctcattatttttcattaaaccagcttgggttgcaacagccacaagcgttcctgctgtatcaaagaacccaacgaataagaacgttaaaatcacgacaagcatttgaatcgagaagatgtctggcaagtgaatcaaggcttgtccaaaggttggagataagcttggaatacttcccacaatttgcgtcggtactgggacaagaccaacaatcattcctgcaatagctgtcacaagcatcccaatgaagacacctgcattcactcgcagcaccattaaaatgacagtcaccacgataccaaacaccgttaataaaacaggaccactatgaatgttcccaatggaaacgagcgtattatcgttattggcaattatgccagagccttgcagaccgacaaacgtaatgaatagaccaatacccgcaccaaccgccagctttagctcagccggaatggcattgatgattttttcacggaaacctgttaaagaaagggcaacgaaaatcaaccctgaaacaaatacaccagaaagtgctgcttcccatgtgatgcccatgccaagaacaaccgagaaggcgaaaaaggcattcaagcccatacctggggcaatcgcaattggatacctggcaatcagccccatcagaatacaccctgcggcagaggctaacgccgtcgcagtaaagacagcgccctgatcaattcgtaatttatctggaaaatccggtaccgacactaaagcaagtgtgatcggattgacaaacaaaatgtaagccatcgacaaaaatgtggttaaaccaccgatgatttctctgcggtaattcgttcctaactcatcaaattgaaaaaactgtttcaagccaactgactcccttcatgtccttttgctttagtctgccccattcacaagtcaaataaaaaacgccccaacagttttgggacgcttgactacatatgtgaattcagacggtgacataaaacaagaacaatgcatgatttatatcaaacgagtgtgaattgacgtagtcaagctatttacggtagcttggtagaaacttgcgggccatatccccgctattatacgacttctatctatttgatttctgtgtctattgtaccaacttcatttttaaaacacaatacgaaaagcgaacatttttcaaagaaatgtccgcttcattcgtcttattacacgaatttggaaaatcacatctagttctttatacacccttctccaaatccttctcttttgcaaaaactgcttcggctacatggaaaaactctttcactgccggagaagcttgggagagagacggacaggcgagcgcaacctcacggtgatgagacacattcaactgacgaatatgcacaagctgctgcgtttttaaaaacagctcagggcctatcgtgacaccaagcccttccccaaccatacgagcaatggtcgtacaatcgtgtacttcaaataaagtagctggcttcaattgagcctcagaaaaaatatcctctacatgcgattgatacatgccagtcggcataataaatggttcatccgccaaatctgtgatgtctacaatggactgctggtgaaaacgatgatttggatgataggcgaccaccatctcatctttgatcagcggcagcatgtcaaagacttcatctgcatgacctttcacaacaaaaccaacatcaatgatgccagagtctagccactccaatatttcttcatacgttccctcataaaatttaaattcgattttcggatgctttttctgatagctcacaagcagcttaggcaataaacaagctgatgcactggcaaatgttccgatacgaatcaagcccgtttcgatatttttcgttaacgcaatctcctgctggatcttctccaccctatttaacacttctctaatatgcgggagaagcgtttgaccgatatctgtcagcatgatgcccttttttcgatcacgaatgaataaggacacaccccactccgtttctaaactcgccaccgcatgactcaccgcggactgcgtcatatttaatgcttcagctgctgcggtaaaactgccaagctcgaccacttttgcgataatatcaaagcgaacaaagctcatgagtattccctcatctccttcatgaaaaacatcaattttacttatgttagcacggaatttaaactaaatacaacgtatcaaattgaaggaagggttcaaaaatgaaaaacacatcctatcagctattgattattcttttagctgtcggttcattcgtcacaggcacgtcagaattcgtcgtgtcaggcattctagatatcattgctgttgatttacacatctccattcctgctgccgggcagcttattaccatttactctctcttttatgcagtaggtgctctctttttagtcatggcaacatcgaaattgaaccgaaaaaaggttctgttatcggctatttttgtgtttattttaggcaatgtagtcgccttttttagtcaacactttgtgctgctcctgctatcccgagttatcatggccatgagtggcggcttatatattgtcgtcgccacgaattatgcagcgcagatcgcccctccagaaaaaaagggaagcgcaatggcaacagtcattactggttttaccgtttcactcgtacttggtgtccctattggcacatttttatcaggtcatgtggattggcactatatttttctcatcattgcactaggtactgcttgtcttttactactgctttatcaattactgccacgcatggagggacattcacatctgccattgaagcaacaattacatctccttcaagatcgcaaagtgatcagcggattagccacgaccgtcttttggatcttaggctacacaatggtattcgcttatatctcgcctttattacgacagactgctggcttctctcttgaaatgacaagtatcgccttgctcattttaggaatcgctgcttttataggctcacgatttggcggcttcgccgttgatcaatggggaccaaaccgaaccatctcgatcagcatcatgatccagatgctcgctctctttgccatattctttacgcaattctctacaataagcatcttgattacacttgccatatggggcatcgctacatggacgacaactccggcgaagcagttttacctcatctctctaaaaccccaagcatcagaaaccgtgctgagttttaatacagcgattatgaatatcggcatgatgctcggatcgtcaatgggcggtgtgattatacaatatacaaatgtcacgaacttaagctggattggcggtttagcaagttttgtcgcattcatgttgattcggtactcgttccatcgtaataggctggcccaaaagcaggcaaaaagcgaacatgtataaccatgttcgctcttttatttattgactagcttttgatgtttcttttttgactggaatggttacaggtatatctctctgtggtgccaatcggttcagatctgacatattaagatcaagtccataatctttaaatgctaatgtgtctaacttcttatcaaattcaaaagtggattgcaaagaggctgtctttacattggtcatctttacatcgttcctctctaagtaatatctgttttcatcatttgcttcagaatctgaccatgattttagctttttaacttcacctaaccctatccattcacctacattctccataatatcttcatctaattctttctggtctactccagtaaattgataatcaactgttacagaatgccccttttgctctattttattgattttgattccaattccatgatgctttgttttgtactgaacaggcagctttgtctgaagaggaatgattttgctttcttctcgttcgaagtccacaattgtgtaaaatgttaattcagtcgcctttggatcgatcggttgattcaaaatggtcaaatgatcttttctagttttttcaggagtcagttgtttttctcctaaatctgttccaagctcaagttggtaatcattacctaaatcatctttcattctatctataatgactctatcatctttggcaaaaccattgtaatcaatggcatattgaataacagaccctttcaatcctttttctactttcacatttcttatttgataacgtccatttaaaatagacacgtctttttgtccagctaatatagtagttttttgcttcactacaggtaattcaaatcgccaattccctactatatctccaattttcaaaatgacgagtggcgctttttgaccttgcttaatcgtctgtccgtttgtatagactgtcacctgtccagcataacgaccatctttcaatttttttaattcatgattgtagtcactcgattgggtggtttcatttactggatctaggttgactacaaatggtactgaattttcttttgtattcaaatgatcgacagtaaatgtataaacaagtcgccctgtatcatagtaaacactgtttacttttacagtaattcctcttgattcagccccctcattaacatgcttcaccatatcactctgaaaaagagacattcctactttatcgtgaaacatcatataaaactgtccaataatcgggacacgtgccatcgctgtattaagagaaggaaaaaggaagcctgatgaaaaataaagaacgattagtatgatgacagagtatattggcgttctccaattccatgtgaaccaacgtcgtttcttttccgctttcacatccccaatggcttgacgaatcgcggaggtcacttcaaccattggtacatcaatctcatcatagagctttttcatttcttttcgttccatcgacactctcctccttttccaacgtttgctttaataactttcttgctcgatacaaatgagttttaatcgttccttcaggcatacccatctgctgagaaatcattgaaatcgaataatcttgaaaataaaatagctgaatcacaatctggtattgctcgtctaacacatcaagtgcatgttttaaatctagcttgtcttccagaaaatcattccgctcaacgctttcgtgctgctgatcaaacggaacaacatcttgctgctttttcttcatcgcaaaaattgtatgaatcaaaatccgagtcagccagctagaaaaataagctggttctttcaagccagatagatgcttaaacgctttaaaaaccgtctcctgaacagcatctaacgaatcctctttatttcttgtgtagagaaaagccgttttatataaacgctcctgatacatcagcattaatttctcaaatgccgggacattccctttttgtgcttttttaattagacgcacttgcttcatctcactcacacctcctacacctgttagagcaagctttctctcaaacggtttcaacaaacggacatttcttttacttagcatatgtcggataaaaatagagaaagtgaagaatggagtcgaaagagcaacttgaacttttgatataatggaagaaatatctacaaaaaggagtatgtcgattgtttcgattcgaagaacccacgtgtgctagctgtcaaaaaaagatagaaggaaacgaagaagtgtacgttaagctggtctatccaaagagaaaaggaatgacagaggtgaaggcttggctgaggaatgaaggggttttttattgtaaggcatgtacagaacaaaagacatcacatggaggataaacacatgaacaaaatgacctttccgcaatcatttccaaccatacataccgaaagactaatcttaaaacaagcaacgatcgaagacgctgaggatatgcatatctatttatccaatgaaaccgtgtgccgctacatgggcattgatgctcataaatccatcgaagacacaaaaggagaaatcaagtggtatgacaatatcttcaaagaacaaacaggcatccggtggggcatttctttaaaagaagatcctgcgatcatcggcagctgcggctttctcaatctagaaaaacagcaccaccgcaccgaaattggctatgaattacaccacgatcattggagaaaaggcatcatgaaggaagcgattgctgcggtgttacgatatggatttcaggagatgaacctgaaccggattgaagcgattattgatccagctaatacgtcctctgttcaattattggagaagattaattttgtacgcgagggtttattgagggagtatgatcttggtcaggatgggtttgatgatgtgtatatgtatgcgattttgaagaaggactacgaataaaacaaatgaaaacagatattcatttcattcaaaagccgcaatcagaatatgtttcttttcacatttatgagcttaattcgacgattgaaaagcttgtccagcaagtggagcaatcagcccccttcttcctagcgaaagatcctgagaaagaaaaaacgaaaaagatttattattacgacatcttatatatagaaagcgtcgataaaagatcgtttttgtatacgacagatggggtgtttcttataaaagaaaagttatttgaactcgaagagcaacttgaggcgcatgactatgtcaggatttcgaaatcgatgattcttaatattgattatatcacgtctatttctcctaaaacgagcggccgtttcgaagcaaacctgacaaatggagaaaaagtgatgatttcacgtttttatattcaagcattaaaagagaagcttgggttacggaggaagtgaacaggatgaaacgttatatcacaaatcttttgatcacattttgtatgatctttactgcactcgtattgatttactgtttcacgtttggaacgatgcccatctatattttacaagcaatcatgttcagttcctttttttcaagcgccctaaccttcttgctatatccaaaacaaacgtacagtcataaacggattctttttcaacaaattctatatatcgtccttgtgatgtgtatgattatgaccaccatcatcatcgtcagcgctgaaatcagtctcctttcgttcatcgtgaatttccttgtggtcatggcattattctttttgatgaagtacctattgtataaaaaagatcaagcaactgctgaggaaatcaacgaacttttaaagcagcgaaagaaacgaacaacatcttaaagtgcatcttagggctaaatattgacatgttaggaagatttaattgtgacttctgcttgattccactattctgacgttagaggaggaatcaaaacatgaaaccaatcacaatcattcgaaaatcagtacttctactgttgttttctttaatcatcccaacaagtgcaggtgtctatatatccatcaaagaagtaaccgatccaacgaacatctatctcatcaatggctgtgcgatgctggctgggtgtcttttacttctattcattattcaaaaaagtcgttttcacttgaaagaaatagggtttcgaaaagggtctcttggtatttggatatttcccatccttatcatcgaggccattccatttattgctggattaaataaggatctaaccctttcttcctttatagcactttgtttcttcatggtgtgtgtcggtctgtttgaagaaggaatctttcgaggcatcctgttccaatatttaaaacagatcaatctgagtaccgccatctggggatctgccgtcctattcggccttggtcattctgctaatctactaagcggaaaaagcctcacattaacagtggcacaaatcttattcgcctttttatttggattcgttgcagctgaaattgtggcactcactaacagcctgcaatgggtcgtcctatggcacgcggtgcataatatcgtggatcaaatgacaactggaaatacgcctgttggaatgcaaatgcttttactatccattcaatgtgtcatcttgcttgttcttgccgtgattttgtggagaaaattaagaataaaaaattgaatgtttaataatggaaggtgagtagaaaaggaggaaaggaatgaaacagcacacttggattgaagaacgaggaaaatggatcaccaaaacgaagaactgaatgatatgcaattttccaatgaaatgaaataaagagaaatgagcgagctcagtgcttcgcttttttattttctaaaaggcattccgaaaaacagaaaaattagatcaacaaacagccgatatcctcagcatcatgttatcgaacttattgattcatgtcatcctctttcagaatgctatatatttctaaatcaacaacctctttgccagaccataaaacagcttgtctaagcagcccttctttgataaaaccatttttcaaaaggactttttttgatacctcgtttgccggcttgacctccgcttgaatgatatcaatctcttcaaacataaatttcactagtttagggacccccttctgttgcaatgcccttaccccaatattcctccgccaagaaatagccaatcgtcaccgcattctttttttgattgaggtccgttgtttcgattatgccagctagcatatgaggcttgtccttaaatattttctattaaatttggtatcaaaggtttgctttctatgggtgatgataaggaaatcaatgtagtggaattcccatacttcatactctcattttcaaataattcaaggtcctttatggattcggctactactttaatcaaataattgaattctccgctaattcggtgacattctactacttgtgaagcctccttacaataatcaacgaaatgattgcatgtggtggttcggaaaaggataaaagccactatgggttttccaattttctcatttgaaatgacagcactatacccctttatcaccccttgctcttctaatcttttcactctttctgtaactgctggttgagacagccctatcaatcttccaagggaagtcattgacaacctagcatctgactgtaaacattctaatatatttctatcaatactatccatgtaataatccctccatatcattagatgatactgacatttcaccataactatttagaatgataagctctaaaaatcattatataataattcaaaaccaatatcattgaattcccttaatttcaaagttaaatacatactaataccttgattatcatatgtaaaactcaactacctgttagtataattgatttcattaactaatcaggagggcttttacaaatggataaccattttaatttaactaaaccaaatcaaaaaccttatacatcaccttcagaacgtctaccttgggctggcttaattgcacttgctatggctggattcatatgtgttcttacggaaacaatgccagcaggtctattgataccgatcagtgaaggacttggtgtgtcagaatccctagcaggtcaacttgttacggcttatgctttaggctcactcattgcagctattccacttacagcagcaacacaaagttggcgtaggaaaccattgcttcttttatgtatgactggattccttgtatttaacacgattacagccctttcttctagtctgactttaactctaatcgttcgtttctttgcgggtgtaacggcgggaatactgtggggaatgacagcgggatacgcacggttgatggcaccgaagtcattgaaaggaaaagctatggctatagctatgattggtacttcttttgcattagcttttggtctacctgttgggacatttcttggctcccttgttggttggagaactgtctttggtatcatgtcattactagctgtattatcaattttatggattttttggaaaataccagacttccctggacaaacttcagaaaagcgaacgagcctattcaaggtgtttattactcctggtgttcgtcccattctatttgttgtattggcttgggtactttcccataatatactttatacttacattgcaccatatctatccgaagcaggcctttcccagcgggttgatttggtcttactcatttttggcgttacatctttaattggaatctggatgataggtatattcattgaacgaatattacgcactttggttttaatgagtcttgctgggtttggattggcatcattagcgttaggtatcggaattagtcagcctgcaatcatttatgttgcggttgctttatggggattaacctttgggggagcagcaacactaacgcagacagcaatagcagatcatgcgaaacaaggtactgatcttgctcaatctatgctggttactgtttggaacctggctattggcggcgggagtgcaattggagccattctgatggaatcatttgacgtaagttctattccattggtcatggtattcctcattgcacttggattactagtagtgtttcgtgcaaatgtttatggatttcctttaaaaacgaaaaagagctagaatccccttatttcagtaagtggcttcaccttcatatcggttcatatacttctcttcatttacgatacgagttgagatttagatgcctacgttgctgttccgtatcgtttgacagaataactaagtgaaaaaacctgccttgaagcgcccggactcatatccgacgcttcaatttcatgtattttagatggctttcatattcacctatacgaacaacaggaaggtacaaaattttcttatttatttcttaaaatgcttttccccgttctttgatcttgcaacatagcacaaaaagtcaagtttctaaaagatgatttccgctatactaaactcgtaaagcaaggaggtgctcgattgtcctatcaagaacatgaaaaaacgattcaagaaacattgaattatattgaacaacatctaaaagacgatttaccgctacaaactctagcgaaacatgctggttattctaggtttcattttcaccgtatgttcaaaaaagtgattaagaagtcagtggttgattatatacgggaacgacggatgacccaagcggcaaaggatttaattcatacggatcaacgggcgattgacatcgcattgcagtatcgatttagttctcaggaatccttcactagagcctttaagaagatatatgacatgtcacccgcacgttatcggaaattattaaggaatgtgattaatgaggaggaaacaaatatggctgatcatcagaacacacctactggctggattatgacgggggataccccatctgaatatgaaacaggtttggataacagaattgtacacagtgggactaactccgcttatttaaaatcaaaagatgaaaaagctggaggtttcgcaacattgatgcagcaaattaagtctgatcgttatcgaggagaacggcttcaattttctgcttttgttaaaagcgaagatgtgaaaggctcagctggtttatggatgagaatcgaccattcttcaggtgaaattcttgcgtttgacaacatgatgaaccgtcccattacaggaacaaatggatggaatcattttagtgtcgtactagatgtttcagtcaaaagtgaagtcattgcatttggcatattactacaaggcccaggtcacatttggatggacgaacttagttttaaaattgtagatgaaagtgtgccagtgacagaacaaaatactgtggatcatttagaggatgaaccagtgaatttaaattttgaaggctaacagactgaagtgaagaggaggttaattgccatgaaaaaaattggtgccattttattgttcgctgtgaattcacttacctttatttgtggccttggatttttatttggtgaagaggataccacattaaaacagaagtaaaatgaagataagacacccataggacaaaaaaaatcaattaaaaaagatatccctaccactatctcttttttgtcatcttggtataatagaaaaaatcagaaaaattagaaagtgctccgatatggtgcagtgtggatctacgggatggatttcaatttcagccatttgtaatacctctccttaaatctcagccattaattatttatgattatattttattatttccgttataaatatacaacaaatactattaatttcaatatttaggttgaagtgaaagacttggtggggaactatataaaaacaagcctattttacagcttttaactcacaataaacactgtaaaataggctttttcaattcattttagtttcttactcccactcaatcgtagcaggcggcttactcgtaatatcatacaccacgcggttcacatgcttcacttcattcacgatacgagtggagatcttttcaagtacatcccaagggattcttgcccagtcactcgtcataccgtcaatagatgtaacagcacggataccgattgtgtaatcgtatgttcttgcgtcacccatgacacctacgctgcggatgtctgggagaaccgtgaagtattgccagatgtcgcgctcaaggccgaagttggcaatttcttcgcgtagaattgcatccgattcacggacgatttctagtttttcttcagaaatttcacctagtacacggatacctagtcctggacctgggaatggctgtctccagacgatgtcgtcaggaatgcccagctctgaacctagggcacggacttcatccttgaatagcgtgttcaaaggctcaatcaattcgaactgcatgtcttctggaagaccacctacgttgtggtgagatttgattgtttgtgccgttgctgttccgctctcaatgatatctgtgtaaagtgttccttgtgctaaatagtcgattccttttagcttgtccgattcatcatcgaatacatagatgaattcgttaccgatgattttacgtttttgctcaggatcagacacaccttttagcttgtttaagaaacgatcttttgcatctactttaatcacgttcatgttgaaaccttcgctaaatgtcttcataaccccttctgcttcgcctttgcgaagaagaccgtggtcaacgaaaatacatgtcagctgatcgccgatggctttgtgaatcaatactgccacaacagatgaatctacaccaccgcttagtgcgcacaatacttgtttgtcgcctactgtttcacggattttctgcatttcgatttcaatgaagttctccattgaccatttgccatcgcagtcacacacgccgaagacaaagtttttcaataggtcatttccgtattcagagtgacgaacctctgggtggaactgaacgccatagaaattcttctcagctaaactcatcgctgagtttggacaatgtgcacttgttgcatcaactgtaaagccttctggtacttcaacaacgaggtcaccatggctcatccaaacgacttgatcagtcggaaggtctttaaataaagcaggcgttccattaatgtggatatctgcttttccgtattcacgctggcttgccgcttctactttcccgcctaaatagtgagtcataagctgcatgccgtagcaaatgcctagaaccggaatgtctagatcaaaaatcttttcatcacagcggaaagatccttcatcataaacactgtttggtccgccagaaaggatgattcctttaggcgccatttctttaatttcttcagcagttaaagtgtgcggatgaagctcactgtacacaccaaattcacgaatacggcgtgtgatcagctgattgtactgactgccgaaatctagaaccaaaatcatttcatttactaaatttgtcatggtgtcacctctatgtccaatatagttttttataaacgcacagaaaaaatgagaggagaaaacctgctctcagtgtgaatcacgcttttgaagcgcccagactaacatccgaacgcttcaatttcatgtattttagaaggttttaatattcacctattctaacaacaggaaggtacggggtcaagactatctcctgtttattaaattttcccataactttgcggattgcccccaaagcactgacgcatcctctcgtcgatagagtgcccgctcatagagctgcgtcagctctgacatccgatgatctccatccttgtcatcgatcaaagaagcgaattctcttagcgtcatgccaggttttttctcaattcccctgcgcttcagctgctttaatagcgcagcatacgcatagaagaatgcttcctcctctggcagacgtttcacctttctcacaataaagaatggcagccatcttgctctgaatcgataaagcatccagctgatcaatcctagaaggatcatagctcctgccgcaaaacccaggattgaaccaacatgtaccatattacgcttcgcttgcgctgtttgtttctttggttcagccggctgcgctgtctcctgctgctgcggctgttcggcctgctgatcttcgcttgcatcggagctagactgatctttttccttttgatcatcatctgcttgatcacttgaagccgattcatttgtaaaggtctctgggttcgtaaaaccttttgtcggttcgaaggtcacccagcctctatttggaaaatacacctctacccatgaatgcgcattgttattggtcacttcatacacattgtttccatccatctgtgtttcatataattgacctgacgtgtaccctttcacccatctcgccggaatcccaatcgaacgaagcatcacaatcatagaggttgaaaagttatcacagtagccgatcatcgtatcaaacaaaaattgatccacataatcttcttgacgactaggcacagcgacattttgcgtttcatatgaaaacttcgcagaccctaagtaatcctcaatcgctttagccttatcgtacatattatccttcgtttccgttaagctgtttgccaatgttttcactcgctctggcaatgaggaaggaagctgtaagtattcacggccaacctcctgattgacctgcttctttgtcggtactttgattctctgcaaatcctcaaggataaatgtaggagacaaaaaggtgacttggtagttccctaaatttttcggcggattttgaatggatgggacgattttctccgttttccccatcatttgcagcggaatgttttccattggcatcagcatgatcgtcccaatcggatagacggcatgattaaatcgataattcgattccatgtcaactctcgtttcgtgctcgtctgtttttacacgctcggtaaaccagcgattcggcacactgtcctcttttagccgcgtaggtttcgtatcatttgaggcatcctcccagccctttccggtgtagatgctttttgtttcgacacgaaagtaggagggttccttaccgctccatttaaagaccggtgtgcggtcctcactaaatggtccgccaagcgatgaatcatctgtactatatcccaccttattctgtccggcagagccatcttgattcgtcaccgccttaaaaaatgggacaggatcaggccatttcggatcagactttggtaaagaagcgccgagtgtcgctgacagaagaacaagcgccagcatgggcaaaaaccactttagacgcgccttctgtgatacccgaatgccttcagtcgaacgcagtcgatcgaaatacagcaacccaagcaaacaaaaaccaaacaccataatacgaacgatcgcaaaggttgcatcatatggcgtaaacgtatccagaatcgtgacatacacaatcgtcataagtaaaaagaaaaagatacgctgctgatagaccacccaataatgaagcaagtagacaagcagccatagcaaaatataaaacaataatgtgcggaaggagggatacatgtcactccacatacctgtgctcatcaaggtgatattatctttgatatcagcaaataatggagccggatagcttggctctgcttgataaaagatcaaatataaggcgagcaaaatcaagccagtacaaataggaaacgtcacataccacttcaaacgaaagaatgtaaacaaacatgtaagccctataaaaatgatgaaataagacgtatgactcgtctctgtaaaatcttgaagcggtcgaagccattcccaaagcagcaggaatgctacagcataatagatgaacaactcaaaacggctttgccgctgatgcgtatgcagcataaatgtttgtcacctcacagttctttcgtgcagccggtcttcaaataaaacggtcgtgcgtattccagatgccttgagccggtctacaagctgtttttcttttgtcgtgaatcgatccacggctctcttcactaaaagaacagtgatgttctttctgtttcgatttccaaagaggctcgcagcaagctcttcatgcagatgacccgtaatgacatattttccagagtattggtactcactcgctgcgaacgctttatattcgagtacgcgagaaggatgatgctgcacccttgttaaaaagtaaagcatgtcctgcaaatgagattccccttgatccactcgaaagacacgctgatcaccaagtgggacaaggcctgccggaaccccttttttcactgccgattggaggacagacgctgcaatagacacgacggtctcaaaaaccgcttcatcggtaaaatcagcaaacacgacaagatcctttgtttgattctgttcaaactccttcgtcatgagctgacctcttctagctgtcgtcttccagtccacccaggcaaaacggtcgccttgctgatattcccttacacctgttgtcacatgggtcggttcatttaaccacgagcgaaccgctttgcctccattttcattcaatgactcagcagactccacctgaagatcgagcattttcggataaacaagcagctttttttctaacgggatgatgacttctttctccacaaaaccaaacatatcacccgttttgattcgaactgctgacaaatgatgttccccgcgcatgacatcattcaattgataggaaaaacgccacgttttccgaaaccaaggaaacagtatttgcttcatttcaatttgttcctgtaaatgaaaggtgtctggcggatcctcctcaatcaagacgtaaacgtatggaaatagatttgtccgcttgatttcaaggtcaacaggcagcacgtctcccgccttcaagtgagtttgttgtaatgtccttttcgcagtcactctcagcggaacaagcgcaaacagcaaagcatacaatgcatatggtaaaaatgcataaaaaaggaaccaactcacaaaccctccttgaaacatggcataacaaaagactgcggcagtgagaatgatgagcatcatcacccgtaaccataatgaaaaagcgaaacgatgacctaatttcattgactcatcgacttttgaactggcacgccaatttgctcaagcatttgtcgcagcagtgtctccgccttcttcccttcatacgtcgcttctgatgtcaaaatcattcgatgcggtaatgtataagacgccaaatactgtacatcatcaggaatcacataatctcgcctgttcaacagcgcatacgcctgagccgctttcataagggcgatcgatccccttggactcacacctagataaacagatggatgctgacgtgtcgcctgtgcaatttccacaatatattctttaatggatgcatccacatgaatggtctgaaccgcttgctgcagcgcatggatatgatcatttgtcatcactgcttggagcgtatcaatcggggactgcttttcctgcaagttgagtacctccagctcttccagcatggtcggataccccatttgtagcttgaataaaaaacggtccatttgcgcttctggcagtggataagtcccttcatattcgactggattctgcgtagccatgacgaaaaaaggatcagcaagtagcattgtttctccgtccactgtgacactgccttcctccatcgcttcgagcaatgcagactgtgtttttggagaggtccggttgatctcatcagccaaaataatctgtcccataatgggtccttgcctaaattcaaattcatttgtctttttattataaatcgacacacctgttacatcagatggcaaaaggtcaggagtgaattgaattcgcttaaactcacagccaatcgattttgccaaagcacgaaccatcatcgtctttccaacaccaggcacatcctctagcagcacatgccccttcgccaaaatcgcaacaaggcttaatatcgcaatgtctttcttcccaaccatgactttattgatgttatctacgattttttttaaatctgaatgcattggttcatcaaatgccatcctgatcctcctatcacgtttccgttaaatttcatatagtctaactttaccatacaacgcgcaattgcatataacatcaacacgtagaaaaaaagaagccttctcacgatggaaaagacttcttctcttcttttggctcacctgctggctccatatgaacatgagagtgaagaatatcatgttccttcttcattctacgttcgatctcatctgcaatatcatggctttctgcaatgttcaagtgcggctcgacctctactactacatccacatggaccgtgcttccgagataccgtgccttaatatctttcaaatcgcccaccccaggtgttgcttcaatggtctctttatatttggacatgtcttttatatgaaaaccgtccgttaacgaatgagaagcatctctgaaaatctcccacgccgttttacaaataatgaggccaatcacaaacgctgcaagcgtatcaatccatgccaattgaaattgagaggcgataatccctacaaatgttccgatactcacatacgcatctgatttattatcagctgctgctgcatgaagagcctggctattgatccgtttggacagattgcggttgtaaatatacacaccatacatcaccacagcacttcctgctgccgtccaagctgcgatcatatcgggtgtttgatgctcagacgagaagagcgactggcctgcactcagcagaacctgaagtccaacaagcatcataataaaggacgccacaagagacgcaatattctctgctctaaaatgaccgtatggatgatcttcatcaggcggtttttgagaaatacgaagtccaatcaatactgcaagggatgcaataatatccgtcgtattattcaatccatctgccgaaagggcttctgaatgaaacgtatacccaatcagaagtttcaccgcagataagatcacgtaggcaatgatgctgacccaagcacctgtttcaccttgtcttaattcgttatagcgctccatgtcgaaccgcgcctcctcacacatcacttttctattatttatcttacaaagcaaagcccgtgtgggtctacagcaacatgattcgcttgtgtcagcaaaataggatacatagaaatgtgttgacctaagtaaacttatttttataaggtcaattgacctcaagacctactcccatcaacctttttccaattcactctgcgaggatcatatgggcaatatcactcttactagtaaattgtcagaaaaattttattttaagacacaacttctcttcatccgatcttatgctatttttaagaatgaacagaggaaaaagagggaacataatctctcaaatcctttatactttttaacatcatgttaagaggtttgaaatgtcagtttgataacctgtccaatgctgaatgacaattcagtgtgataaaatttaaaatattctaaaaacaaattctctatcaggagaaatgtttggaggtaaagacatgtccaacatgacaaacggtcttcaaaaaaatcttaaaacaagacatatttcaatgatctccattgctggggttattggcgcagggctatttgttggtagcggcgctgtcattcattctgcagggcctggatccattctttcctattcttttgccggacttctcgtgatctttattatgagaatgcttggagaaatggcatgcgcctatccgacaagcggttccttctcacaatatgcgagcgacgccatcggtccatgggccggttttacaattggctggctttattggttcttctgggtgattgtcatcgccatcgaagccattgccggtgctgccattattcagtattggtatggagatgcacctgtttggctcacaagtcttatcctcactatcctcttaacattaacaaatatcttttctgttaaatcttttggcgaatttgaatattggttctcattaataaaagtcgtcagcattattctctttctactcatcggttttgcatttatctttggttttggtggtcatcatacagtaggtcttgccaatttaacggggaacggcggtttccttccaaatggattcagctctgttttactcggaattgtcgtcgtcatcttttccttcatgggaacagagattgtggcaatagcggccggagaatcagcagacccggtcaagtctgtgacaacagctacccgctctgttgtatggcgtatcatcgtgttctatgtcggatccatcgctgtcgttgtgaccttgcttccatggaattcagcaagtattttaacaagtccgttcgttgcggtattagaatacatcggcgtcccatcagcagctcaagtcatgaacgtcattgttttgacagccgttctatcttgcttaaactccggattgtacacaacgtccagaatgctttattcattggcagaaagaggcgaagcaccgaaacgctttatgaaaatcagcaaacgtggcgttcctgtagcggctacagtcgctggcaccttcttttcttacattgccgtcatgatgaactacttttatcctgaaaccatctttttgttcttagtcaatgcatccggcgcgattgcccttcttgtctacttggtcattgctgtttcacaattaagaatgcgccgtaaaatcgaaaaagaaaatccagaacagctcaaaatcaaaatgtggctctttccatatctcacgtactttaccattttggtcatttgcgccatcttggcatcaatgctgtttatcgaatcaatgagaccacagctcattttgacgagtatcattaccttcggtgtgcttgccgcttatttcatctttaaaccgaataaaaaagtgcctgcaaatgcatcgcttgaaaataaacatccgtaatgctcccgctgaaaagcgggttttttattttattcacctattttgatgtccgcacttatactgtatcaaattggattttaagtgaggattagacaacatgaacctagaaaaatttgttgacgagctgccaattccagaagttgcggagcccgtcaaaaagaacccaaggcaaacgtattatgaaatcactatggaggaggtatttctaaaagttcatagagacctgcccccaaccaagctatggacctataatggcagtttgcctggtccaaccattcatgcgaatcgaaatgaaaaggtcaaagtgaaatggatgaacaaattgccacttaaacattttctaccggtcgatcacaccattcacgaaggccatcatgatgaaccagaagtcaaaaccgtcgttcatttacatggcggcgtcacaccagcaagcagtgacggctatccagaggcttggttttcacgagactttgaagcaaccggccccttctttgaacgagaagtgtacgaatacccaaatcatcagcaagcctgcacattgtggtatcacgatcatgcgatggcattgacacgactaaatgtgtacgccggtttagctgggttttatttgatctcagatgcatttgaaaaatcgctagaattaccgaagggtgagtatgatattccgctcatgatcatggaccgtacgtttcaggaggatggcgcgctgttttatccaagcagaccaaacaacacgccagaagacagtgatataccagatccgtctatcgtgcccttcttttgcggagaaaccattttggtcaatggaaaagtatggccgtatttagaagtagaaccacgaaaataccgttttcgtattttaaatgcatccaatacaagaacttacgagctgcatctagacaacgatgcgacgattttgcaaattggatctgatggtggctttttaccaagacctgttcaccatcaatcctttagcattgctcctgctgagcgatttgatgtcatcatcgatttttcagcttacgaaaacaaaacgattatccttaaaaataaagccggctgcggacaggaagtgaatcctgaaacagatgccaacatcatgcaatttaaagtcacacgtccgttaaaaggaagagcgcctaaaacattacgacctattttcaaaccgcttccaccgcttcggcctagtcgagctgataaagagcgcacgctcactcttacgggtacacaggataaatacggccgccccattttattgctggataaccatttttggaatgaccccgtcacggaaaatcctcggctgggcagtgtagaggtttggtccatcgtcaatccaacaaggggtacacatcccattcatttacaccttgttcaatttagggtgatagacagaagaccatttgatacagaggtctatcaatcgacaggggacattgtgtatacaggaccgaacgaagcccctcctttacatgaacaaggctacaaggacaccattcaagcacatgccggtgaagtcattcgaatcatcgctcgctttgttccatacagcggcaggtatgtgtggcattgtcatatattagagcacgaagattatgacatgatgcgaccgatggatattatttagtaacttgaaaccaacccccatcacatacgtaaaaacatgtattgagtaaatcattacgaagggctaacagacagcggtatattagccctttccttccttttcattgaagcattctaaaataaaacaaagcatgacttgaaatggcatttatttgtacattcaacacttaaaaagttgacgcagcaaaccgataatactactatatacccattgcatctatcaaaaggcacatttgccacaatgaacgaacaaatggaaaattgcgataaaaaacggaggagttcaatttgaatgaagaaaaagagacttgccagatcacacaagaaacagcggcaggtaacatagagaagctttcaattcagaaaaacgagagcattcggtcaaatattgaacagctaacaattgaactcggtgaacaaaaagaattcaaccacttcatattagatgaaaaacaaaaggccatcagcacattatctgccctcattacaaaaggcgattgtgatgaagaattaaagactcattttgaacaagcattacatatcggactttctgtcatagagatcatggagattattaagcactgtacaaaagttgctggattccctcactccattaatgccctgtttatctttcaaaacttattagacaataacaccaaataaatcagtgaaaacgagaagccatctgtcctctcgttttttatgtccattcatattactctctttcttttcctctgtcacataagcaaaatatgaaaataccacacatttcccaccttaaaaactgattttccttacataaattcctcaatttctgcaacatgtcaaacgacaaaataaaaaaacgttcagttatataaaaataactgaacataccttttatcgattgacagtgaaattgttaacaatcccgccatccttctcccacgcggcttccactgtttttttcttgatatcgtattcaaaaatcgttcttacctttgcttttcgtccggtgtcatcctttaattcctttgcgtttttagcaacacctaagaaataaacagaagacccgtccgtagaaaattgcggctgtgcggcacttagaatatgcacacccttactgttcttaacaagtgttgcctgttttcctgtttctacatctagcattttaatagaggatacttctttttcatttcgcatcttcacttctgtataaatcaatgtcttatgatctggtgaaaatgaaatatcattaatcgtttgcgagatgcgtgcaattcgcttccccttcgcgcctgtttgaagggtgatcttcatagtcgttggttcagggtctcttcccttttcattcgcttcgtcggttttcttgtaatcttcttttaaggaataatgctggattgccagaaggtttgacgccggatcatatgcaaaagaacttaccgtgtcatccttgcttttttctggatacaatacatccactttacgtgtgttgacatcaaacatagcgacataaaattgttccccagaatccttattatacctaagatataactgtttcccgtctccagacagcctcatactgtcgatggaatcatcactcgtaaatagcgttttttcttcatccgtttttacattcagttctcgaatactcactttttgcgtgtcttcatccgtatacgtgtaatataaaagctgtttcgtagaatcataagcaatcgaaggatatgctgtcagtttctccgtatgaagcgcccggtcatgcagataatacgtattgtttaactgttgatctgtaaatgaaacgagtaattcgtcttttgcattctgatttgttttcacttttcccgcatgcttcgtctcttgatccggcttcatcataaagaaaatgacgaccgcaatcactgcgactccgatgaccgtgatgatccaccatgttgattttttcattgcctttcagaccctctctacaagaaaagaagccagaaaatgaacttttcccgcttctttgcatgcctatgtattaataagtgtaatgtccttttacgacacctttacttgttttatacccaagtgctttgaatgcttttggactaacgtctaatacagcgtttggcattctacctacatcatatttatatactgtaatcactttatgtggtttcgcttttgttgtcactcttaattttgtaccttttttcggtacgtcaaatcccattttagttgctgcatcccaatgaccgagtttttttccatctgcgccttttttaccgacaccattataccaagtaatattgccgcttactttttttgcacttgctccatgtgagaaactaaacgccaaaaataaactagctactgttacgattgtcgcgataagctttttattcattaaaaaatcctccgtatttggtttctgaactcattatacatgaagatgcacccctttattttacagacacgttacaattcgaatacaagttgaccacttttcgaccggtttttttcataattaataccaaaaccatccataaaattgtaagtagatccccccttttgattttatataataaaaatgaacccattataaggaggagttttcatgaaaaagtggtttatcgttttgagtgtaagtttgacctttgttttgatgctatcaactatcccagcatctgcagctagccctcgtcacggcgcgattgtgacacaaacggatgaggccaaatggtcgggtatctcagctgatattgtgctaccgaaaacagctaccattaaaaatggctatgcggactggtatctcggtctcggctctgccgttgttgagagcggtatttcaaaaacgtcttctggctacaaggtctttctgggcagcggctcacaaggcggcagcaaatactggaacagtgaatacgataagagcattaaggatggcgcacgtgttaacttaaagctcatcaataatggtgatggcacagtgtcactatacgtcaatgggacattgcgctataaacagcctgtttacaaccctagccgtctgaaaaacctcgatgtcgtcaagatggtacacggtgtacaagataatggaacaaacagctactcacaagcaagcttctcaaatgtacagcttcgtgcaaatacttcaggaagcgtctataaaaaatgggatggatccatcaaatcatcgcttttacgtaaaaatttagagtctggtgctgcggctcccaaattcaccgtcatttcttctgttccattaagtacaagcctttcagcacaataagaaaaaaaagcgccctttttgggtgcttcagattgttgacaaagggctaaaatgaactttattttagccctttgttttcttttcagcgtgatagaaaacctttgaagtctaggaaggacgagcatcggagcggagcgaatttgacattcgtgagcaccgaagcgcagacctgacaacgaatgcgaaggtttgtctacacgctgaagcgccctttttgggtgttttttattgttcacagcatatcaacacttctcttttaatcaaatcaaggattcgtggtaacataaacatacatacttcgaagaaaaaaggagaacgaacgtgaaaaaaagtctacttgttttcatgagcctagttgcaggtctcttcatgctagcagcttgctcaaatacggcaaacgaacaaaaaacagaaacgaaggcacttccaacgattaatgaacgcattcaaaaagaaacgaaagaagtcatggagcagtctaaacttataaaagacacggatatcactgttgatcaacaaaaaaaagtcatttctttacatgtaacagcttcttctgataccaatagtgattacgctgaagtcatcggtttaaactttgccaagacgctggccattggggcatcaactgaaaaagaaaacaacctgcacaaacccgaaaatgacagccttggcgccctctattccttttacgacctaaacatcaccgtgaaacaagaaaacggtaaagtgctggcaaagggaacgaaaaaaacaaatgaaacaaagatcacttgggaaagagcgcagtaatttagaaaagcttgtagaggatcgctctacaagcttttttcaagtttatataaacaaatcgtctctcatcgcatcgaccagtgtgtgaatatctgagtgagcccatgatgctaatcgtaccaacaaatcatctatacactcatacaaatgacgttccctcaaaatatactccttataaaatggaatgacaaagaaatagagcaaatcagccaattcaagcgcaacgatatcgttatcctcaacttctaatgcctgtccaacacgttgaatcagccaatgcaaatctgctttcttttcaatcggaacatacatcagttgatgaatgttatccgtatccttcatttgtaaaatccgctcagccgcttcctttgacagcgccccaatttctgtagaagatatattaacaaccgctaattcatcctctgatctcacttgattcatttgcagcaagttttggtccatcttgactcactccccatttctcagatacttttattataaggaatcgatctgattttttatggaaatagtggatttttttatgtaattttaaagaaaatgtgacattataagccaaggtatcttatatctctcaaataaaaaagcactcttgatcataagagtgcttttctcatacatcttttactccctttttcattgcctcagccatttccacgtcaccctctgcttccaacttttcaatgatgtgagcataatccctttcattgcgattttggcttattttaaaagcatcctgaacttcatcaatgatgattttaaagcctacaatgcctttcatttgtttctctaacaattcatcagataacgtatgccataacactggttgttctctatgtctttcgtatgtctccagcatcgttgttaattccttaaccagttccgatttttcaaacagtaccgcctttccataaacatgaacagcctggtaattccatgtcggtactgattctttttcataccatgaagaggatatgtaggcatgcggcccttgaaagatgacgagcatcttttcattttcttcaaacattttacactgaggattcccaatcgccatatgccctgaaatcacatacgaatcgtcaacttgatgaaaactcaccggaatatgtgtcgcaatgggcttttcattcattgtcgtcacaactgtagcaaatgaatgagattgtataaatgatttgattttctctaaatccttcacttgaaaaaatgatggaacatgcatgttctcttcccccttttaatcagttcaatgttttggtcataatgaaatccatttgctcttcgtcccccatgtgaaaggcgtgcaccccttgcacccctgtttgaacaaacccaagtttttgatagaaagcgatggccgctctattatgctcccacacccaagccaaacatttcgtttaagatgatttttcgcaatttcaatagcttgatcaattaaatatcggcctaatccttgcttttgaaaggattgcctgatataaattctttcaatctctaacgcgtcactacccatctcttctgattgggcatcatccatattgaccttcaaataaccagcagtttccccattcacttgaacaaaataaaactgtgaagaagggttctgtaattcctttaacaactggtttaggtgaaaagctgtcttcacgtaagcatcgagatgttcggctttgttttgattcgcaataaattcatgcagttctagctttttgatagcacgagccgcctttgttcgatccatcttaatcatttccgccaacttttcctgaatgatacctagctcctcacaaatacgcacaagatataaatacttatcgtactctttaaattcaatattactaatgcaatcaatcaagcacgcgaacaagcacgccgatctaccgcaaaatttctttcatgtatctcgacttcatttttgttgtaatttcaataaaaaaaccactttaataagaagtggttttcaactctttctttatttatcatttatattttatctaaacatgctgattagtacgaaccttgaagaacctgaatcataccatcagtaaccagcacatattcaattaggatacgagtgatgacaaaagcagttcatttcttacttgaacggacacttttcttcaacaactgtatatctttagagaaatttttaggttgtatgctgctcaacacctttttctcaacctcaggagtccaatagattttcaatttatttcttgctcgtgtaatagcagtgtacaatatattatgtgttattagttcatcgacttcgtctgtgatgacaattttaacagagttgtactccaaaccttgtgccttatggatggataatgcataagcaacttggaatggtataatcgatattgaagagccttcatcatcttcatcagtacttttaagtttgttaacacaaaaacgtataactgaattcccactttctgtgctgtcgatcaattcaaggtctaggtcaaaggtatgcagactatttattacaatatctagttctatatcaaattggatacgttcactgggcttatcattatcaagaatccttattccaactattctccctttcatattattataaatcaagggagtaaagcgatcagattcattaaataaaatcggatcacctattttgtactgctgaattccccagaaaactggatcatttttattactattttgtaagaagcgattgatattatttattccatataacccgtcataattaagacaaagaataatttcgtctgctttcgcaggatcaaaaatagaaacgtctaactctttagaatagcctctttttgcaatagtttctaaaatagtattgtccattttacgtactttatcccaaagtgtaagcagtcccttgtcactactacgataaggttttgttaattcaaaaatagaactattgggaacaaactctttagcaacactaaaccaattcccaaacctaatagaagatatctgatatgaatcgccaaccataagcaaaagcttgtggttagctttgttaagaatatctctcatatcttgattgtttaccgtactacattcatctatcactatcagatcgtagtctgtatcaacacacttcctttttaggaactttgtaattgttaaaaaatcacaattcgcggctgtcactcttctttttaaattatccacagcagggttagtctgtgctaaaaacaacttcttcttattaacaaaaaaatgtgatatatgatttataagtgtagatttcccagttccggcagaaccgtacatcaaagcaactcgtgatttttcaaacatttgagttaaaataacttttttctcatcgcagtcaacaccatgatttggctcatctaaccatgctttcaccgaattggcatagttctcaattccattttttgaaaattcctctagttgcgcaataattaaaagggtgtctttcttatatccattaataaaaagctgccctgaatcaactactaatttgcttcgttgataatgtttttcatgcaaatttgaattgtaaattttaataagttcatctatttcatcaaatccaactatatcttttatcggtgtgaagagttggcccttgatttctgtattattcctaactagacgagcaagtatttcatgttttctttctctagcatcaatacaagcaaacaaatcactcaacttaggattatgccccaaaggagatgaattaaagggaatcttatcaaaaggaatacttccgtattgcataaaaacccttgacaacttagggtttccactgtcaccttgctgttttttaataactttattgttcatatgataaagtaaataacgaaggatattactacccggagcgtttgtttttattattttacgacaatgttctaaatcatcaaagaaaacagccttcttaagtcgttgagtaacttgttgttttatatttagaaattccgaatcgctgaagtccactagttgtgttaaattaaacccagatgtcaaaaactttgaaataccctgctgttccgcatatcctgtcgaaactgaaaagcctctgataagtcttgtgaaatttttatattcgcaatcacgaatggagacttcccaatctactataatcataataggcatagttttacctagaatctctatattatcttgagctaaggttaacttggcagcatagttatctgttatatccaactttgtaaatgcaataactctatcaaatttgctagcataatcattagcaggcgtaaaagtcacctcataataaacctgttgattgataaagaatggtttaatcttttgaatatagtatctttctgatttattcccatcccgcataccaaagtgttctactttttctgcaatcttctcatagtattcccttaaatttgaatctgtgttaagtggaaacttatcaaggttttcaaggatatttaatgaatacttatcattcatgagatttttaatttttaaaagatattcataatatttaagcattaaacgctctgaattttcttcatccaatgtatagtgtgatgctacgatttgcaagtattcatgaaattgtctaaggacttttaaatttccctgcgacttaacaaattcaattgctttagtgatattagcatattcattttctatatcttgaccgtttgcatagaacttcaacattaaatgctcaacaaagttacgtagttgtgaaagaatgtcttgtgaaactgctcctcttgaagaaaaatcactgttgtctaagtgacggcaaataactctatttatattaagaatctgtgtgtctaatgtatatgatgttacattggtcatactgcacctccattaaatttactacccagcttttaaaagaaaaaagaatctaatatcttctaatctattagttacattttaataaatttaattcgacaaaatttgttaaaaccctctaatattagactcattgatatataatattcaaaagttcagcagtatgaattattttagaatacatgacgtcataatataagcagacattacaaaataatttcctttcatggtaaatattttattgtaattaataaccttattatttacaataaaggagataatttatatgaaaggatattaaaatgtcattagaacaaacaaccaattcaagtgaaaatcaagaaaaattaacaacaacatgcgatacatcaattttatatcctagctctgaaattttactttcaacgataactagagaatacgatgctgaagctaatagaaaaagagatatcgaaacaagagccggagttttccttgcacttttaggagctttaataggcttttatgcaacagcgttggacttttcatttttcaaaaaagcgaacagtccaattgaaatgttatgttttgtaataatcgccatgctatatattttccctgctattatgcaattgattgcgtttaagcacttaattaatgtattaaaaacgtatcaatacgagtctcttggactaggtgggtttaacccagaaaatatagaaatgagcgccaaacttcgtaaagatgaacttcaatttcttttatcatcttcataccatgctgttgttgagaaaaacagtattgctaatgacactaaagctaaactttttagaaatggtacagaaaagatatacatttcaataattggtattgtttttgtatatttcttcaaacaaatcattcttttgttgaattaagaaaggagcaaaagagatgtcagacaaggacagttggtggaaagatacagccgttaataaaaaagaagatactgataaaaaacaagataaagaaaacatttttttaacttcaagaaaagtactgaattacggcgtaccacctaaaaataaagacttcgatccaagacaagtagagtacgacgtatttccaattgatattgtgaagaatttaaaaaaagacaataaataaacctctctaaattcggagaggcttatttattattttaatagtgattgaagatataaaaaatgcaaataaagcatgagtggatgtcacaatattgtatttgctggaataaagggtccatactggagatattaaaactattgagaataggtttaatgcagttctaaaaaaatcagggatacagaagaaattaactcctcattctttaagacatactcacacctctcttcttgctgaggctggcgtggatcttcaaaggataatggatagacttggacatacagatgatcaaacaacaaccaaaatacaccttcacataacaaaagaccgaaaaaaagaagcttctcaaaagttcggagaactaatgaaaagcctctaatttatctatgtggcatcaaaatggcaccaaaatgagtgtgacttacggataaacccttattaatcaagggtttaaatccgtaattacatcatgccacccataccgcccatgccgcccatatctggcattccgccgcctgagccgccttcttctggtttgtcagcaacgactgcttcagttgttagaagcattgctgcaacagaagctgcgttttgaagtgcagagcgagttacttttgttgggtcaacgattcctttttcgatcatgtttacccattcgtttgttgctgcgttgaagcctacgccaatttcttcgtttttcaagcgctcaacgatgactgatccttcaagacctgcgttgtgagcgatttgacggattggctcttcaagagaacgtagaacgatgtttacacctgtttgaacgtcaccatctgcttcgattgaagcgacttttttgtatacattcacaagtgctgtaccaccaccggatacgataccttcttcaactgctgcacgagttgagttcaaggcatcctcgatacgtagtttacgctcttttagttctgtttcagttgcagcaccaactttgatgacagcgacaccaccagctagttttgcaagacgttcttgtaatttttctttatcgaattcagaagttgtttcttcaacttgcgcacggatttggttgacgcgtgctgcgatttgagcagaatctcctgagccttctacgatcgttgtgttttctttagtcacaacgactttagacgcgcggccaagctgaccgatttcagttgattttaggtcaagtcctaggtcttctgtgattaactctccgccagttaaaacagagatgtcttcaagcattgctttacgacgatcaccgaatccaggtgcttttactgccactgcgttgaatgttccacgaagtttgttcacaacaagtgttgcaagtgcttcgccttctacatcttcagcaatgatcaacaatggttttccttgttgtacaacttgctcaagtacaggaaggatttcttgaatgtttgtgatctttttatccgtgattaagatgtaaggattttcaagaactgcttccatcttatcagaatccgtcaccatgtatggtgaagcatatccgcggtcaaactgcattccttcaaccacttcaagctcagttgtgaaccctttagattcttcgattgtgatcacgccgtcgttacctacacgctccattgcttcagcgattaggcttccaacttcttcatctgctgcagaaatagacgcaacttgagcaattgattctttgccttcgattggtttagaaatctcgtgcaagccttcaagtgctactttcactgcttcttcgatccctttacgaacgccaacagggtttgcaccagctgttacgtttttaagaccttcacggatcatcgcttgagctagaactgttgcagtcgttgtaccgtcaccagctacgtcgtttgttttgcttgcaacttcagccacaagttttgcacccatgttttcaaatgcatcttctaattcgatttcttttgcaatcgttacaccatcatttgtgataagtggagaaccgaattttttctcaagaaccacgttacgtcctttaggtcctaaagttacttttacagcatctgcaagtgcatctacaccacgtaacatcgcgcgacgtgcttcttcactgaacttaatatcttttgccataataacgaaacctcctcagtctttttaaaaatgtatctcaatgttttttatgtgattaaccaataacagctaaaatgtcgctctcacgaaggattaaatattctttgccttcatatttcacttcagtgcctgcatattttgagaagataatgcggtcgcctgtgtttacttctaacgcaacgcgctcaccactttcaagtacacggcctgaacctgctgcaacaattttaccttcttgcggtttttcttttgcagaatccggtaacacaataccgctagcggttttttcctcagattcaacgagttcaatgattacgcgatcgcctaatggctttaacataagaaacaacctcctcaatttttatatgtagtctttttttagcactcatcaccagtgagtgctaacacatttattataataaagaatgtcttctgtaatttcaagtaaaaacctttaaaaatttttacgctttcatgatcttttttcaactcagattctttccttttcatcgaaaaagaagacttgtgttacaataaatctagttcttttagtaaaggggttttcgttacttgaaaaaacaatattggtacatcatcttaacgtatatattggtgcaggtttctgcgtttccgtatgtgttcattatgaagtggttaggttacattcagacaccgatgacacaagcagagctctctaaattgtcaggtacatggacaatcatcagcttctgtgtcggattaatcattattctgctcatccttcggactgtaccaagagcttcacttcgaaatgaagcaccggtttcagtcggcgcggcaatcgtttggatcattgtcggtttctttctttccctcttagcacaatcaattgcgggggcgattgaacaatatgcatttggcattggccgagaatccgaaaatactcaaaacattttagccattatggatgcagttccatggcttgtaatcgtcatcgccctgattggaccgatattagaggaaattatttttcgaaaaatcatctttggtgtggtttatgaaaaaacgaattttttcattggagcacttgtcagttcagtggttttcgctgctgtacacaatgattttccccacatattgctctataccgcaatgggctttacctttgcctttttatatgcgaaaacaaaacgaatcattgttccaatcggtgctcatatgctgatgaactcgctcgtcattcttgtgcagattgagccagtacgaaaaatgattgaagaacaatctcaaacgatgcaaatgattattggaggctttttctcatgagaaaccctgtcgtatggggcatcatttattttgccgtaggtgtggctttcacctatatggccattcaaaatccaggtgacatgtggtcattttacagcattttgctgatggtgtttgcggcctataatattaatatctcgctcaaaatgtttgctttctctgttaaacttaaaaaacagcagcaaaaataaatcaaaaaccattttccgcacgtggagaatggtttttttatggaggaccagttttcatggaacaagaaaaactgaacatcttaaatgagcagcatgaaacgattggagttacaacccgttcagatgtccacacccaaggcctttggcatgaaacctttcatttctggcttctcaaaaaggaacatgacaccatgtatctctattttcagctaagaagtcccgccaaaaaggatttcccttctctttttgatatcaccgcagcaggtcaccttcttgcaaatgaacagccttctgacggtatgagagaggtagaagaagagattggttttactataccttttgaggatttgacctttgcaggagttatacaggatgaaatccatctacccgatttgactgatcgtgaattttgccatgtctatctttacgtccatcaagaagagcagatgaacattcaattacaaaaagaagaagtcgctggactttacagagcaaagctaatggatgcacagcagcttttcacaagaaaatgtgaaaacatgcagctggagggctttgaaattgatgaaaccggagaacgatgtgaggaaagcagagtagtctgtatacaagattttgtaccgcataagccttcctattatcagcatctatttcaagcgatcaatcaattcctttcataatagaaaaagcatcgtgacccttatttggatcacgatgcttttttatgagacatcataactttctttctcctctgtctctgtttgctgcattttgcgatatgtcactctcgaaatgacgatactcacttcgtataaaacgagcatcggcaaggtaaccatgaggtgagaaacgatctctggcggtgtaatgagtgcggcaatgacaaggaggacaaaataggcatacttccgtatttttgataaaaacatcggtgtgatgatgccaagtcttgtgagaaacatcaacacgacgggcatctgaaacaaaaagccaaatggaagtgttaactgcatcagaaatgtaaaatactcatgaatcccaatcacttgctctacatttaaatcattcgacatccgcatcagaaaatcgacgacaaacggaaacaaaataaaataagagaaagccacaccgctcaaaaataaaagcagtgcaatcggaatataagcaagtgtcacctttctttctttttcatataagccaggactcacaaacgcccacagctgatacaaaatcacaggacacgtcaaaatcaaagcaatgacaaatgcgaactgcataaacacgtacagcggatctgtgagcttaaatgcatttagtgtcagtgtggccgcttcatcggtattttgtaaatacacaatgaccggcttagcaagaaaaaaaccagccaccataaaggcgacaaaaaacatcgcaatgatcactaaacgttttcgcagttccacaatatgctccataagcggcatatctttgacattcatgaagctcatcctattctactgatcttcttttttcttactttcttcctgatcatcagctaaaccctttgtggcatttttgaattcacgtaatgtatctcctgctgctcttcctaattgaggaagctttttcggcccaaaaataatgagcgcaacaatcgcaatcagaaccaaacttccaggaccaatcggacccatttgctccaccccctttaccccttttcgtcaatcctcctgtgtaatagagtaatgctttaagaaatacacaagagactgaagttcaaccgccaaatctatatgatgaattcgaatgtgttccggcacattcaatcgggccggcgtaaaattaaggatccctttgatgccaagggcaatcaaacgatctgtaatgggttgagctgctacagcaggtactgtcaaaatggcaacaggaatatctcctacctcttgaacatgctcttcaagcttatccaaatcatagacaggcacgccgcctatctcacttcctattttactctcattgacgtcaaaagccattgaaatttttgtattattgtttttgatgaaattatagtgtaaaaatgcagtccctaaattcccgacaccgatgagcatgacattggtcatttcatcttggtcaagtgtttttctaaagaaggtcaaaaggtaatcgacattatagccataccctttcttcccaagtgcaccaaagtacgaaaaatctcggcgaatggtagcagaatccactttgactgcatcactaagctctgctgatgacaccctttgttttcctgatgcatgcagattttttaaaaaacggtaatatagcggcaaacgtttggctgtcgcttgtggaatttttgactgatctatattcatataaggtcctccaacttaaatatcagatgctctgtgaaaatcaccgtttttcccgcctgtcttttcaattaaataggtaggaccgatgatcatgcctttatcaatcgctttgcacatgtcgtaaacagtcagtgcacatactgaagcagaagtgagcgcttccatctccacacccgtacttccttttgttttcacttgtacttgtatgttcagaatgtgcgcatttccgtcttcctcccaatcaaaggagatatccacaccttttagtgcaagcggatgacacattggaatgatggtagatgtttgctttgctgccatgatgccagcaacctgtgcaacagacagcacatcgccttttccaatttcacgttgctctattttatgaaacacttcttttatcatacgaacacttgaaacagcaacagcggttctcacggtagacgatttgtcactaatgtcgaccatctttgctcttccctgttcgttaaagtggctaaattgactcatcttttcaacgctccctcactcaaatgatacactattttttcctatctgtctttcatttgaatatggcgattgtatgtatcatttgctggtttactgctgataagctacacttaacatattatagcagaggtgaagttacatgatgattctacaagtgaatcagctgtccaaatcgtttggtgctgataccgttttaacgaatataaaattggaagtcaaagcaagggatcggattgccattgtaggtcgtaacggcgcaggaaaatccacccttttgaaaatcatcgccggtcaattgtcttacgagcaaggtgagatcatcaaaccgaaagacctatcgattggctatttagcacagcataccgatgtgacgtctacacgtacgttaaaagacgaattattatcggtttttgatcatttgaaaaagatggaacaagagatgagaaccatcgaggagaaaatggcttcctccacaagttcggagctggattccctcatgaaaacctatgacaggctacagcaggaatttaaagatcaaggcggctatcaatacgaagcagacgtccgctccattcttcatggactcggctttagtcactttgaagatgagacaaccgttcaatccttaagcggcggccagaaaacccgtctagcacttggaaagctcttattaataaaaccggagctcttaattctggacgagccgacaaaccatttagatattgataccttatcatggctggagcagtatttgcaaaattatacaggcgccattctgatcgtgtcccatgaccgctacttcttagacaaagtggtgaaccatgtatatgaagtctcaagaactgccatgaaaaagtttgcaggcaactatagtaagtatcttgatctgaaagctgagcagctagagcgcgatatgaaactttacgaaaagcagcaagaagaaatctcaaaacttcaagatttcgtagatcgcaacctagcaagagcctcaaccacaaagcgcgctcagagcagacgcaagcagctggaacggatggatcgtatagataagccattaggtgatgaaaaatcggcaaactttcattttgatattgcgagacaaagcggcaatgatgtgctgaaggtacatgatctcgacattcgttatgatgaaaaaacaccgcttctatcctctctttcttttcagatcaaacgcgaggatagcgtagcactcattggtcctaatggaatcgggaaatcaacccttttaaaaacgttaacgaacacattaaagcctgtaaaaggcgacatcatctttggatctcatgtcacaatcggctactatgaccaagaacaagccaaactgacatcctccaaaaaagtgctcaatgagctttgggatgactatcctcatatgaatgaaaaagaaattcggacatgtttagggaacttcctcttttccggtgacgacgtcttaaagcccgttcatgcattaagcggtggagaaaaagcgcgccttgccctggcaaagctgatgctccaaaaagccaatttcctgatacttgatgagcctacgaaccatttggacttagatagtaaggaaattctagaaaatgcactgattgattatccaggaaccatcttatttgtctcgcatgaccgttattttatcaaccgtctggcaacgaaagtattcgagctgtcgccaacagaaacaaaagagtatctcggtgattatgactactaccttgaaaagaaaaatgaacaattagagcttaaggcgattcaagaaaatgaggcgcttaaaaaacaagcagcaaagcccgttgaaacggcaaagctttcttatgcggaagaaaaagaactgaaaaagaaagaaagacaaaagcagcgcagaatcgaggaaattgaagagcggattgctaacattgaagcgaagcttggtgaaaatgaagagcttctatgtgatcctgccatttttcaagatcacgagaaggtccaaaacattcaaacagaaaatgatacgcttcatcaagagctggaatcccttttcgcagagtgggaagagctatccgaatcttaaagagtgccctaatgggtgctcttttttcttttagtgaaaatttattatccacattagtatccacaataacttctttattattcttttaaaaattggacttatccactttatccacagagatttaatcacatatccacatgaaagaccgtgtttgtgcacatccacttcattttaaaacgaaattttctaataattgtggatatatcacgtttacatgtgaataaatcgctttcattaaaaatgaaaaaaacctgtgtatccacaggagttttcattcatatgagacaagcggtaagcccggctggccattcattgccatatcgcctcttatacctttttcaaacgcaatggttccagcagcagcgatcatggctgcattgtctgtgcaaagagataacggtggaatgatgaccttcacgtcaggaatctttgtgaatgctgtcgttaaggcttctctcagtcctttattggcagcgactccaccagctaggacaacctgcttgacaccataggcctcagccgcttttaatgttttcccaacaagcacctcaatgacacttgcttgaaagcttgctgccaaattctctggagcaattgtttctcctttttgagatgcgttgtgtagtgtgttaataacagctgattttaatccactaaagctaaagtggtaggaaccttcttcaagccatgcacgaggaagcttaatcgttggctctccttcatgtgctaaccgatcaatatgaggtccgcctggatacggaagacccatcgtccgggccactttatcgtaagcttctccagccgcatcatctaatgtttctccgatcacctcaaaacagccgtgctctttcattagtacaagctcagtatgtccaccagagacaacaagagccaagcatggaaactgcaattcatctacaagttggtttgcataaatatgccccgcaatatgatggacaccaacaagaggaatttgatgggcaaagctcagtgccttggctgcattgacaccgatcagaagggcaccgactaagcctggtccttctgtaacagcaatggcatctaaatcctgaaagctcatattggcctgtgccattacttcttctaacacgatggtgacttgctccacgtgatgccttgaagcaatttctggcacaactccgccaaaccgtttatggctttctatttgcgacgcgaccacattcgctactatttcttttccatttttcacaatagatgcagctgtttcatcacagcttgtctctatacctaatatgaatcgatctgtttgttcattcatttatattcacccacataaccaatgcatcttctccattatccgtataataattctttcgaatagaagctggtctgaaaccaagcttttcataaagggattgtgcaggtgtatttgaaacccgcacctctaaagaaagatgatctgtctttttttctttacaaaactccatgacatatcgcagcaatgcttccccgtaaccctttcctctatgctcagggagaatcgcaatgttcgtaatttgtgcatcgtccatgacgatccagaccccgcaatacccaacaggctgctcatcttcttcaatgaggaaataatggctgtactggttatgaagaatctcatagacaaatgattcttttttccaaggggcagtaaacgaatgcacttcaatcgtatacacctctggaatgtccgctaccgtcatttttcgaatctcggttatgttgagattatttttgtccttcaagccatttcacttccgcttctgccatacgaatatagttaggaacaagctgatggacatcttcagcaggacgatctgcccctaaaaacgcaagcattgaaggtcttgggttatgaaaagctccctctgctatcacagccgtttctcctaaaatggagcgaatgctctcttcatgaagatgcacatcctgtccaaggaataggacaggctttcctgtctgcttcagctcatgaagccaatccgtgagcaagatattttggtcttgtttgatctcttggatctttccttcttcaaacgtatatagtccagtataaacttgtcctcttctcgcatcaaatagtggtgagatccatccatcaaagtattgaccatttgccgcaagtgtttctaaactcgaaacagccgatatcgggatagacagcgtccatgcgagtgtttttgcaatggtcacaccgattcgaacaccagtgtaggaaccaggtcctttcgctacaacaattttacttagctcacttggggctacaccacattctttcatcaatgcctcaacagtcggcattgctcggacggaatggttcttttttaaatacgtaatgctctcaccaatcactgtggaatttttgacaagggcaattcctagtgtatggtttgacgtatcaattgccagtatggtcaaattctttcatctccttacaaagggcctcatagcggtccccttttgcactaaacgtgagatgacgttcttcttcacgttctgttcttagcatttctattttcaaataggaggaaggcaattgaggtccaatgagatgtgcccactcaaccaagcatacaccttcgccctcaaaatattcttcgagcccgatatcttcttccgcatcttccatgcggtacacatccatatgataaagtggcagtctgccatcagtatattctttaataatcgtaaaggtagggctgttgacgatacgggtaatccctaagccttctgcaaaaccttttgaaaaagtcgttttgcctgcgcctaaatccccttctaatgtcaaaacatcgcctggcatcacaagtttggccaatgcagcggcaattcgtttcgtctcatccgcaccttttgtcgtccacattaatttcactgtggatgtcacctcatttcttaaaatgattatatccttttttcgttaacattgtttgctgttcattatcttttaatagaacgcttgctgtttggccatctttgacttgtccaatacgggtgatgtaaatgtgttcttttctgcattgcatttcaaagctttcccaatcagcctctggaatcgtaccagttaatacaaagtcttccccgccaaataacacccattccagccagtctttacgcagcactggtaaatctggatgtatggggagcttgtttgtttctatctctatcgtcacatgactcgcttcggctatctcattcagctcactcgctaatccatcactcacatcattcaaggcgacccgcgggaagcttgagcaaatgagaccagcagtaatgtgtggctgaggctttttatgacgctcaagaaaaaaagctgtgtcgactgccttgggaggggctacttcgttcattaaaagtgataagccagcagctgatgaacccagctcacctgtgacaaagacgacgtctcctgtctgagcactgtgacgataacaagcttttccctttggtacttcgccaatgaccgttactgtaatgacaaagtcactgcgagtggccaccgtatctccaccaatcaaatccatttgataagtatcagcgagtgctttcattccctcgtaaagagctgaaacgaccgtctcatcaccatgaggcggaatcgcaattgatacaagataatactttggggttcctcccattgcggcgatatcactgacattgaccgctagtgctttaaagccaatctcaaaaggtgcggaaaaatcaaagcgaaaatggacatgctccaccattgtatcaacacaaacgacctcttcacaatgtgaatgaggttgataaacacttgcatcatctccgatgcccataattaaagaacgctgatgtgtttcttttggtgtaattcggcgaataagatcaaattcatccataaaaagacagccccttcatgcaatcaattgattgaatagacacgatgtcagacataattagtattagtgtaagccaatatgagtttcagtttcaattaaaaatgatataaagaaagcctggtatgaaaaaaccaggctgggttgaagtgatctatctttttttacataacgtgtagccaaacacaaacccattcaatgtatcttggatacgtatgaaaagaaaaagacataaaaaaaaacgaaactatacgttttcgtttacaagtcataaaaatggcggtccggacgggactcgaacccgcgacctcctgcgtgacaggcaggcattctaaccaactgaactaccggaccattttggttgcactcaatgagcactcccattggtatataaaataatttggttgcgggggcaggatttgaacctgcgaccttcgggttatgagcccgacgagctaccgaactgctccaccccgcgacgatataaatttaaggacgccgccaagctttttgtttatatccttccaatggaagaagttactttatcattccgcagtagctcagtggtagagctatcggctgttaaccgatcggtcgtaggttcgagtcctacctgcggagccatgcttccatagctcagtaggtagagcacttccatggtaaggaagaggtcagcggttcgagcccgcttggaagctttcctctaaattataatgatgaatgtttaaggtttctcgatgatgagaaggctttttttgtttgttttaaaaatgttgaacttgctcagtgacaagtagactcatgaaaatggaataaatcgattgataaggaagctttgtatcaattttctacgcattccttctttttgttcttgattccttagttcctttcttatattcttactaaagtgatgatatcctctctaacaaaagactctgtacgttcctctttttccccgaaagtgaagcattttttattttcctttcttcatcccaggtttgattgatcttcttttccgtgtacggtatgtatataaaaaggagtagatggtttgaaagatttatttgtaaagcaagaatggtttgggcttgtgcgtcaggatgtgcttgcgggtattttagtggctctcgctttaattcctgaggcgattgcgttttcgattattgcgggcgttgatccgaagattgggttgtatgcttcgttttgtattgccattgtgatttcgtttgttggtggacgacctggtatgatttcggccgctacaggggctatggctctagttatggttaatttggtagccgatcacggactgcagtatttgtttgcggctacaattttaacaggtctgattcaaatagtgtttggactttgccgagtgtctcgtctgatgaaatttattccgaggtccgtgatggttggttttgtgaatgcgttggctattatgatctttatggctcagcttccgcatttcgttggggaatctatggctatgtatatcatgacgggtggtgctttgctaattatttatttattgccgatggtgataaaagtgataccttctcctctcattgccattattgtcatgacgatcattgctgtatttggacatattgatgtgagaacggttggagatatgggagagcttcctagttctttgcctgcttttctgattcctcaagtaccgtttagctgggagacacttgctatcatttttccttattctttagcgctagcgatggttggtttacttgagtctcttttaactgcacagattgtcgatgatatgacagagacgtctagtcgtaagaacaaggaagcgagaggacaagggattgctaatgtggttgcagggttctttggtggtatggctggttgtgcgatgattggtcaatcagtgattaacacgaaggcaggcgggcgtggccgtctttctacctttgtggcaggtgcatttctaatggtactgatttttgtactcggagatgtggtggttcaaattccaatggctgctcttgtggctgtgatgatcatggtctccgttgggacattcgattggagttcctttcagcagctaaaaaagaatccgaaaacagattctattgtgatgattgtcacggtggtgacggtggtgttaactcatgatttatcaaaaggtgtttttgcaggtgtgctgcttagtgcggtattctttgtggccaaaatatcgaagcttcatattacctctacagaaagacaagcagggacttgggtttatcgaattaaaggtcaaattttctttgcatctgtcactgatttcattcaggcgtttcatcaggggacagatctccaagccgttgtgattgatttatctgaagcgcgtatatgggatgaatctggcgtggcagcgatagaacgtataaaggagaagtatcaagcagctggcgtacaagtagacatcgttggaatggatacacaaagtcgaaaacttgtgaatcaggtaaatggttcataataagttctttctgtttgttacaatagaaaaggtaagaaagtgaaggatgggggtggccggcatgcttgtgcgtttgaaccaagtgctcggccggatgatgccgcttattacgcccattagtgtgttacttggtgttttattagcggcttatttaaaggattttacgtttatggtgccttgggtatttgccattatgacattttcagggagcttatcgtctactttttcatctttaaaacatacggtgatgcatccattgcctttgattttatcgtttatgattttgcatgtgctgatgcctctttatgcatggtcagcggggcatttgatctttgcgggtgattccatgacgatcaccggtttgacgcttgcgatggtgattccgacaggtgtgtctagtttaatatgggcggcgatgtataaaggaaatgtcgggttaacgttatctattattttaattgatacgttgctttcgccattgattgtgccagtaagcttgtcactcttcgttggtacacaggtccatatggacatgtttgcaatcatgaaagggctgttcggtatggtggtgctgccctctattttagggatgctcgttcgtcagtatgcaaagccatcggtgacgaaaacattgagtcagaccttggctcccttttcaaaattaggcttgtttgttgtcgtatcgattaacagttctgttgtcgccccatatttgcgtgaactggatgctgcattttttagcaaagcagcgactgtctttttcattgcgatgagtgggtatgcttttgcgtggttgattggaaaggtaatgaaatgtactcaaggagagattgtggccattgtgtatacgggcggcatgagaaatattagtgcgggagctgtgcttgctattagctttttcccgcctgctgttgctgtccctgttgtgattggtatgctgtttcagcaagtgcttgctgccttgtttggtttcttactcaatcgctttgagctgaaagcacctgctgtgactaaatctttatcatgaaaagacctccatcctatgagatggaggtcttttttcgaattaatagatgagatatttcttccgtttcttttcgaatgatttgaggtcatgatgatagtgcttcatgatgtgtttgacagagttaccttgattgatttcttctttgatccaaccatttccgatgagtttatcaaagctgccagtttgaaggaactgaaagtcttttggatataaatcatgtatggctttgaggatggataaccctgtttttaccgcttcgaatgaagagcggtctgtgacgtatagctgcacaccgtgtgatagcttccctgcatgtttagaaaaagtgggggtgaatgatacaggtctaaattttacaccctttagttttaattgatttaaatgatctgctagctcattgctattgatatatggagcgccaatgagctcgaacggttttgttgttcctcttccttcagagacatttgtgccttcaattaatcctgtggcgggatatacaaaggtactatccactgtcggcatattaggtgaaggaaggacgaacggcagcttcgtgtcttcaaacgtcatggaacgcttccaatttttcattttaatgactgtgacatcagcattgatatgaaactctttgttaaagaatgttgctagttcaccagttgtcatcccatgtcttaatggtattggatagagccctacaaaagaagcgtgctcaggttctaagacagggccttctacttttagtccgccaatggggtttggacggtctaggacaacaaagggaatgttgttttctttcgcagcctccatcgcataggccatcgtgtaaatataggtgtaataacgagcgccaacatcttggatatcaaacagcaagacatctacatttttaagcatgtcaggcgttggttttcttgtttttccatagagagagtatacaggaagacctgttttttcatcggtataggattcgacgccttctcctgcttgtgcatctccgcgcacaccatgttcaggtccatatagagcagtaagcttgatatttggatgctcaaataggagatcgacactgcttttcatatttgcatcaataccagttgggttcgtaatgaggccgacccttttcccttttaaccatgaaagattgcctgagagcagtgtttcaatccctgttttgactgttgctttttttccttttgtatctgttcgttcttggtttgtgggggaggcggcagtcaatgtactcattatgagaatgcttgcgagtatgaagcttgctgtttttttcaagagaatccctcctatttgatctgtttccctttcaagttaagtccatagccgaatggatacaggatttgattttgatgagtgacagatgggatatctacaggcagtttgcctttaggtgatgcagtgccaaatatgacttctaacccagcaggaatatttggctggttaaattgtccgtttgagtagcctttaaaaccgtaaacagctagtaaggcatccgcctcctcaaaatttgccgcatcgtaagggtttcttaggctcatgatgaccatttttttgttttgtgctgcagcttctttcatgacagcacgcgggaaagccgtcgcccattttttcgggtcctgtacattgtcatcaattacaccatcattcacagctgggtcattttggacaacgtaagagccagtaatcacatattcagcaccttgtatgagtttggctgtttctttggtgaaggtcttttccgcaaaagcatatgattggatacgtacaggcttgatctttttttgtttgatcagagagtcaattgtgacagacatagcttttgtctgatcttcgtaaggtgccatgaccaagattttgtcattctttttaggcttgaaagggagggtcttattgttgtttttaagcagggtgatcccttcacgtgccattttttgttctgcgttccggtgcgactttttcccaacgacttgagtggcttttttgatttttttctcaagggtgatgggttttttggaagagatgatgcctcgtttgatcttcaattgaaggattttttcaacagattcgttgatttgagacatcggaatttctttctttacaattgcctgttttacagcattgaacacattctcaaggtttttctctgttttaagagaagtgactggtgctggcatgagggcgatgtcgacgccagccttaatggccatcactacggcttcttcctgtccgaagttatctgcaatcgctttcatatttagggcatctgttacgacaactccttgaaagcccatctcttcttttaataagtttgtgatgacttttttggataaggttgctggaaccatgatgtcctcgccatcttttttgcttttatacgttgtattatcaatagcaggaaattgaacatgagcggtcatgaccatatccgcaccagcgttgatcgcttgttgaaacggatacagctccacctttttaagacgatcgagatcatgttctacgagcggcaagccgtagtgactatcgacggctgtatcaccatgtcccgggaaatgcttaagtgtcgaaatggtcttttccttttgaagtcccttcatggtttgaagaccaagccttgtgacaagagcaggatcggagctaaaggaacggacaccgatgacggggttgtttgggttattattcacatctagaacaggagagaagtttgtattgatccctagtgcgtttaattctttaccgatgatttttcctgtgtcgtatgcgtttttcttgcttcttgaggcaccaatcgacatatttcctgggaaatgtgttcccttttgtaatcttgtgacgattccaccttcttgatcaattgaaatgagtaatggaatctttggtgatgctttttgaaattcatgggtgagtttgacggtttgtttcgtatcaacgacattctccgcaaataagatgacaccgcccagatgatatttttctacaagatgggatacttctttattcatctttgttaagcctgtaggtgcggattcatcttttgtctgccaattacgaaagtctggcataagcatttgacctatcttttcatccaaagacatgttttgtaccatttgttttgcggttggaagaggcgcagagctaaccttttccgttggaagggaagaggttagtagagctaaaaccaaagcagcggggaaaagtgcttttaacatcgaattcctccttttacttaaaagattcgtagatggcggtcatgatgcttccgtaagtgccagttgggaaaaggtcaccttcaaattgatttgggttggtttcaggtgaaacgacaggcgaatgtttcttatttgtcagcaagatgatacctagattatgttttggatcaatcaaagtcatggttccggtccagccagtatgtccataggcttcgttactagcatattttccaaacatccattccatgtcagtatgaccgtttttacgccagcctagcccgtatgttgggtttgtatcagaagaggctgtaaagagatcgatagaagcttgatcaaagatggtggtttttccatagcctcctttgttcagcatgagctggagcagcacggccatatcggatatgttagagaaaagtccagcatgaccagaaattcctgccattgagtaatatgctttctcatcgtggacttcgcctagcagggtgtacctgcgaatgttttcaaaatcaatgacaccatctcgcgaattacctaaacgttcggttgctgcaaaatgcttcggtttgaatcctttttgcagtggattgaacattgtgtgtttgagacctagcggccgatagattgtcgactctacatattgatcaagaggcatacctgtttttttctcaatgatcatgcctaacagcatgtaatcaatgtcactataaatgtgctgggtgcctggtttgtattgtagaggcaccttcggcagccatttcatcgttgtctttctatcttgagagtaaaaggtgccggctgcttctttgctataaaataagacactggaagggagtccggcagaatgggtcagaagatcttttacacggagctgatctttgccggttacctttgcatctggttcatctttaaaatctggcaggatggcttgtattttttcgttcacattcagttttttctcgtagacaagcttttgcagggcatagttggtcgcatacattttggtattggatgctaagtcgaacagagtattctttttcattttcttataggatttgagttccgttgtgccttcgtatttttgcctgtagccataggctttttgatggacgatttttccgtctttgataatgatgagtgcagctcctggaaaacctgctttgatatcgttttgaatcatgtgatcaaccttcctaagctgcctagaagaaaaaccaacttgttccggtcgttttgccttttttaagacgggatattcttcaggtgctgttttagacaaagacgatacaggatgggagctagttgcaaatgtttgtgctggtaatccaaggagcatgagcagacttgttattaagagaaagtatttcttcaagagttagacctcctatagcttatttttcctcaaattcaacagccatatcatcatgaaaaccaaataagtatgtgaaaataaatccagcgacataagcaatgaagagtccgattaagtaaagaagcatttgatgtgtgtgaacaataaaggttaatggaagacctgatacaccaatcgctttggttgcaatttggaagtaggcttgaaatgctcccccgattccagcgccaagacaagcggtgagaaatggccgtcccagcgggagtgtgacaccgaaaatgagtggttcaccaatgccgagcatccctgaaggaagtccaccggcgatagctcttttgagttttttcttttttgttttcatataaatggcgaatgcggcacctacctgtccagcaccgcccatagcgagaatcggcaaaagcgggtcatctcctatggaattgatgagttccatatgaatcggtgtcagtccttggtgaagtcctgttacaacaagtggaaggaaggtcgcaccaagaacaaatccagcgaagattccgcccatatttaatagataagttaatcctgaggtaatggcatccgatataaatccgccgactggcatgaagacaacgtacgtaaaaatgcctgtaataagtagtgtgatggttggtgtgacgatgatatcaagtgattgcgggacgaagcgtctgattcttgtttccacaagtgccataaagatagcagctagaagaacaccgataagtccgcctctgcctggtagaatatttgtgccaaatagcataatgtctgcggaggctgggttaataatgaggattccagctaatgcgcctaatgcaggagagcccccaaactcctttgcggcatttgttccgactaatataccgagatatgcgaacaaccctgaaccaataacggttaaaatgatcgccgcttgagatttttcatcaagccagcccgcttgcacgattgcttttgtaatcccagtaataagacctgatgcaacaagtgctggaatgataggaataaaaatgctggcaattcgtcgtaagaacagcttgaacggtgtgcggttcttttgtgaaatggcttgcttgtttttttgtgcttcgttgtttaaatcataggagccagaggcatttagcagttgttcaaatgcacttgatacttggttgacaacaccagtacctaagataatttgcagcgtttctgcctcgacgactccaatgacgccatcgagttctttgattgcattgatctgaacttgttcattgtcaatcggtgtaattcggagacgcgtcatacaatgtgtatgggaagaaatgttttcagaaccaccacagagagaaagaatgtctttcgccaactgctgatatttcgtttgatgactcatgttgaatccccctttgtttttcgtttcatggagcggatggcatgtcttgttttgtcaatatattgcgctgtctcttcatattgacgggaagctaagctgaggaacaagacatcaattaagtagagctgtgccattctagaggaagtggctgcactgcgaaaaggtgcttcattggaaccggacgtcgatagatgaacgtcacataaggcagaaacgcttgtttgacctggatgcgtcaaggcaatggttttcacttgattgtcttttgcgagctgaagggcttgaatgatgtctaacgtttctcctgaaaaggatataccgaacacgatgtcattctttcctgcatttgcgatgaccgttgatgcgatgtgcatgtcagtgaaggcagtcgctgcataattgattctgagaaatttctgctgggcatccgctgcgacgatgccagatgcaccgacgccgataaagtggatttggtttgcatgcagcagtaattgaacagccttttctaacgcatcggcatttaaaatagaagctgtgtccttaatcgattgaatcgagtttcctgctgttttttgaataatggattgaatcggttcatcttgttcgatatcacggtagccttgtttatcgctatgcatcaagtcgcctgcgatccgcatttttaaatcgtgatagccatccagcccgagagatttacaaaggcggatgactgcagagctgcttgcaccggccgcctgactgatctcgtgtactgtgcttttaatgactttgtcaggatgggcaaggatatagtctgcaatgattttttcagattgggggagctttgctttcattgtgtgtagtagggtgagtccacctgctgacatgagctctgcctcctttaggattgatgatgtgcgatggctttgtcgatatgaccattcgttttgttgagtaaatccttggctgctttcttgtctgtgtttgtttggagcatgacgatggcagttttgacttctaagtctgccgaatcaagcgtttttacggcttgttcgtaggaagcgtttgtcacatgttgaatgatggtgatggcgcgttcttttaatttatgattgctgacttttacatcaaccatcaagttttcatatactttcccttgtctgatcatgacagaggtggaaagcatatttaaaatcattttatgagcggatgcggctttcattcgtgttgaccctgtgatagcttctggtcctacaacgacttcaatggcgcagtctgccagttcgctaatttttgcctgttcattacagctgagggctactgtttttgcgccgatggatttagcatagtttaaagcgccaatgatgtagggtgtcctgccgcttgcggcgataccgacgactgtatcttttgatgttaggtgaatgtgtactaaatcctgtttgccggcttcttcactgtcttccacatcttcggcagcatgtgaaaaagcagagtctccgcctgccatgatgccgacaatcacatcaggtgagacgctataggtaggaggacattcgacagcatccatcacgccaagtctgccgcttgtcccggcccctaaataaacgagtctgcccccatttgaaatggattcataggcgaagtcacttgctgttttgacatgtggtaggacacggttcacagcttgagcgaccttcatatcttcttcattgatcatctggagtatttcaagcggatctgcttgtgatattcctattgtgttaggatttcttgattctgttgtcaaagaacgcaattgagatggctgcatgcgacattcctccttatttcttcattttcagtatattcagtatgatatgaaatttcaacattatatttaaatactgaaattatatttcaaacaaaaagtagtgctaattgaaggtaaatagttagaaaataaaaaaaataaaaatcccctttacaaaagggggacaacctgtatataataacttttgtcagcttcacggaaacagtcaaacttgacaaattggcccgttggtcaagcggttaagacaccgccctttcacggcggtaacacgggttcgaatcccgtacgggtcaccatgatgtggaggattagctcagctgggagagcatctgccttacaagcagagggtcggcggttcgagcccgtcatcctccaccatatgccggtgtagctcaactggtagagcaactgacttgtaatcagtaggttgggggttcaagtcctcttgccggcactgttttttctttatcaattccatatgtggaggggtagcgaagtggctaaacgcggcggactgtaaatccgctccctccgggttcggcggttcgaatccgcccccctccaccatttttgggctatagccaagcggtaaggcaacggactttgactccgtcatgcgttggttcgaatccagctagcccagttaagacaccttttttaaaaaggtgtcttttttttatgttggcaggcggaatgtataactattcaaaatattgttgagttgagtcagaaggcatcaagaaagtaaactataagcatgaacggaaaggggatgtacatatgggagatcaaaagaaggtcacgattatcggggtgccgatggatttagggcaaatgagaaggggcgtcgacatgggaccgagtgcgattcggtgtgcaggcgtaaaagaaaaattggaatcgctttcatttgatgtggaggatctcggagatattccggttgaacaaagagatgatgaaaagggtttatatacaagtgaaaagctaaaaaatttaacggagaatgctggtgcgaatcagctgctcgctgagaaggttgacagtattgtgcaatcaggttcattcccgctcattttaggcggtgatcatagcattgccattggcacacttgcaggtgtatccaagcattatgaaaacttaggtgtcatttggtatgatgcacacggtgatttaaatacagaggaaacctctccttctggaaatatacatggtatgccgcttgcagtcagtctcggccttggccatgctgatttgacgaacattggcggttattctccaaaattgaagcctgagaatgttgttttaattggtgctcgatccttagatgaaggagagcgggcgttgataagagagaaaggcattaaagtgtatacgatgcatgaaatagatcgtttaggaatgacaagggtgatggaggaagccatttcatatttaaaggaaagaacggatggtgtccacctgtcgcttgatttagatggattagatccagcggagtgtcctggtgtaggaactcctgtggcgggcggcattagttatcgggagagtcatcttgctatggagcttttagaggaagcgggtattttgacttccgctgaatttgttgaggtgaatccggttttggatgaaaaaaataaaacagccgaggcagctgttgcgttgattggttcgttaatgggcgaaaagctattgtagagcgggacttgttcccgttcttttttgttttggataaatttaaggatatattaaggtttttactggtggatatgcgtaacacgctgtcaaaaatttgttacactattttttagaggagaatgaaaccttttggaaagaggttcgtatacataaagaccggtgaaggcagaggttgaatatactatggacacaatgattaaaaagagaattaagcaattgaaaaaaggcgaccagaacgcatttgcagacatcgtagacctgtataaagacaaaatttatcagctgtgctatcgtatgcttgggaatgcacacgaagcagaggatattgcacaggaggcgtttattcgtgcctatgtgaatattgaaagctttgatgtgaatcgtaagttttctacgtggctgtaccgcattgcaaccaacctgaccatcgatcgtattcgcaaaaaaaagccggattattatttagatgcagaggtggcaggaacagaaggattgaatatgtattctcaaattgctgctgatggcattttgccagaggaagaggtggtgtctcttgaattatcgagtaccattcagcaaaaaattctaagattacccgataaatatcgttcggtcatcgtattaaagtatattgatgaactctcgttaaaagaaattagtgagattctaaatataccagttggtacggtgaaaacgagaatacacaggggtagagaggctctccggaaacagttgagagacctttgagtgaggtgattttgatgagttgtcaggaaaaaatcgtcctgcttatgcatcagtatttagacggggacattgagccccaagacgaaaaagaattaaaaagccacctgcaatcgtgtgaggagtgccgtactcattttcaacaaattgagaaatccatcgcgcttgtgcagagtacatctcatatagaagcaccaactgatttcactgcaaaggtgatggcaggtcttccaaaggaaaaaaagcgtgtgtcgattcaaaggtggatcaaagctcatccgctgatggtggccgctgccctctttctcattttgatgggaggcagtttgtttacaagctggaataccgatcataatttcagtgtgtcgaagcagccgaatctcgtcgttgtaaatgatacagtgaccgtacctaaaggggaaaccgtaaaaggtgatgtcactgtcaaaaatggcaagctgattgtagaaggcaaggttgatggaaatgtcaccgtcgtcaatggggaacagctgactgcttctgccggacaagtcactggtcaaattaatgaaattaatgaagtgtttgattggatttggtacaaaatgaaatccacagcacaaaatgtgatgcgggtcattggaccagaggagcaaaagtaatcatacgggtcgagagcagtctctttagggactgctctttttctatataataggtcagaatgtatgcgaactagcacgccagccatatatggcaactgttttccttgctgaaacaaaatgtgatataatagccacgctatgtatttacacataggctctttttttattaaaaatgcatcaaacgaagaataactgaaaattctggaggacgaggaaatggctttaggggatattccttttttgcagtacctcggtaatgctgttgatattctcgttgtttggtatgtgatatataaattaatgatggtcatccgcggaacaaaagcggttcagcttttaaagggaattgtggtcattgttctcgtcaggatgggaagtgcgtatctcggtcttaacacacttcaatggctgatggatcaagcgattacgtggggattccttgcgatcattattatttttcagccagagctaaggagagcgcttgagcagcttgggcgcggccgtttcttctcaagaagcgggacacctgtagaggaacagcagcagaaaacgatcgaggcaattacaaaagcaattaactatatggcaaaacgcagaatcggcgcgctgctgacaattgagcgtgatactgggatgaatgattacatagagactggaattcctttgaatgcaaaggtgagttcagagctgctcattaatattttcattccaaatacaccgcttcatgacggtgctgtcattatgaagcgtgatgaaattgcagctgcggcttgttatttaccgctgtcagaaagtccttttatctcaaaggaactagggacgcgtcatagggcggcagtcggaattagcgaagtgacagacagcttgaccgtcatcgtttctgaggagacaggcggcatttctgtcgcaagaaatggtgatctccaccgagaattgacagaagaagcgcttgaagaaatgctggttgctgaatttagtaagaacagcaaagatgcttcctcgaccaaatggtattggaggggcaagaaaaatggataagattttgaataatcgctgggccgtaaagcttcttgcattggtcttcgctttattgctgtatggtgcagtcaattcagcgcaagcgcccacgccgaaaaaaatcggtgaatcctttttcccaacatcgacgacagatgaagcaaccctgactgacattcctgttaaagcgtattatgatgatgagaagtacgtcgtcactggtgtgccgcaaacagttaatgtgacgattaaagggtcaacgagtgctgtgaaaacagcaagacaaacaaagaattttgaaatatatgcagatatgcagaatttatccactggtacccataaagtggagctgaaggcaagagatgtatcaaaaggactcacgctatcgatcaatccatctgtgacgacggtgacgatacaagaaaaaacaacagcagaatttcctgttgaaaccgaattttataatcaaaataaaatcaaagacggctattcacctgaacagcctattgtgaatccgaaaaaagtcacagtcactggttctaaggacgtgatcgacaaaatttctgtcattaaagcatttgtgaacctggaggatgtcgatcagcaaattgaaaaggaagcgaagctcactgtgtatgatagcagcgggaacgagctgccagtcgaattgagtccgtctgtggtgaatattacagttcctatctcaagtccaagcaaaaaggttccgtttaaaatagagcggactggcagtttgccggatgggattagtatctcaagtattgagacaagcccgagtgaggtcacagtgtacggctctcaaaaagtgctggattcgcttgattttattgatggcgtcaagctggacctaagcaagatcaaagatgatacggagattgatgccgacattcccctgccagatggtgtgaaaaaggtatcacccgaaacagtgaagatcaaagtgaaggttgcaacagcgcaagaaaaaaagatcgataatgtaccaatctctgtcgtaggtctgagcaaggatctcacctctgattttgtgagcccatcttctggacggctcacattaacagcaaagggatcaaagagtgcgattgataaactaaaggcttcagatgttgaagcctatatcaatgtcggggacttgaacgaaggaacacatgaggtcacagttcaagtgaacggtcctcaaaatgtgacttggacattatcgagatcaaaggtcaaagtgaaactgacttctaccgagacagaagatcagccagcgtctacaaatgatcagaagaaaccatcttctgatgacggtgatcaggaagagaagagtaaagaagataccacgcaagataaagcaaagaaagaatcaagtcaaagacagcggatcaaagaagataaaaaagaggacgaagcgtcctcttgaatggtaaaaaaggagcgattgaaacatgggcaagtactttggaactgatggtgtaaggggtgtggcgaatagcgaattaacgccagagctcgcatttaaaattgggagatttggcggctatgtgctcacgaaggataaagaacgtccaaaggtactcgttgggcgagacacacgtgtatccggtcatatgctagaaggagcgctcgttgcaggcttactttcaattggggctgaagtgatgcgtttaggtgtgatctcaacacctggcgtgtcttatttaacgaaagcgatggatgcagaagcgggtgtcatgatttctgcttctcacaacccagttcaagacaacgggattaaattctttggcggtgacggctttaagctgtctgatgaacaggagaatgaaatcgagcagctgatggatcagccggtcgatcaattgccacgcccggttggagcggatcttggaacggtgaatgactactttgaaggcggtcagaaatacttgcaattcttgaagcagacagcagacgaggatttcacaggtattcacgtagcgcttgactgtgcacatggtgcaacctcttctctagcgacacatttatttgcggatttagatgcggatgtgtccacaatgggaacatcaccaaacggattgaatatcaatgatggtgtaggctcaactcatccagaggcgctttctgcttttgtaagggagaagggtgcagatattggtcttgcatttgatggtgacggcgaccgtttaattgcggtcgatgaaaaaggtgatattgtagacggcgatcaaattatgtacatatgtgcacgttatttgaagggcgaaggccgattaaaggatgacactgtcgtttccacggtcatgagtaacctaggtttctataaagcgctcgagaaacaaggcattaagagcatccaaaccgctgttggtgaccgttatgtggttgaagcgatgaaaaaggatgggtataatgtcggtggtgagcaatcaggccacttgattttccttgattacaatacgacaggtgatggcatgctttctgcgatcatgcttgtcaatacactcaaagcaacaggaaaaacattgtcagagctagcagctgaaatggagaaattcccgcagcttctagtgaatgtgaaagtgtctgataaatataaagtagaagaaaatgaaaaagtaaaagcagtgattcaagaggttgaaaaagagatgaacggtgacggccgtattcttgttcgtccatctggaacagagccgcttgtacgtgtcatggcagaggcgaaaacaaaagagctatgtgatgaatatgtgactagaattaccgctgttgtgaaggaagaaatgggtattgagtaatagatagcaaagcaaatcgctagcagcggtttgcttttttttcgaataaacgtcataaatggatggatttgtacgaatcttatacgcgagggcaatttgctgttgtcttcatacataagagagcacatcaaaggtagaacgagacaagcctcatcgcatatagtgtatggaggtcttactttcttgaaagggatcacccgctacattgtgattgacggaggtcagaccttatagtacaatcatccttgtgttactggatttttattctatcaggaaaggcagggtagatgttcagaaactctcttataattatagcgcccgaactaagcgatcggacgaaagatgcttagttgacgaggatggaggttatcgaattttcggcggatgcctcccggctgatcaaaaaagagatcacagccgtaagtgtttctttaaagcaaagaggtgactctttgtacaaagggaatacacatgatctcccaaattaaacatgtagagagggacgaagaaatgtcccttctattgtagtaggctttctttgtcccttttacatgatcgggaggaagaatatttatgtgtggaatcgtaggttatattggtcagaatgatgcgaaggaaatcttattaaagggtttagagaagcttgagtaccgtgggtatgactcagctggtatcgctgtggcaaacgaagaaggcgtgcatgtgttcaaagaaaaaggacgtatcgctgagcttcgtgaagttgttgatgcaaacgtagcatcttcagctggaatcggacatacacgctgggcaacacacggtgtaccaagccatctaaatgcgcatccgcatcaaagtgcttctggccgttttacgcttgttcataacggtgtcatcgagaactatgtacaattgacacgcgaatatttacaagacgtcacactaaaaagcgacacagatacagaggttgttgttcaagtcatcgaacaatttgtgaacagaggtcttgatacagaggaagctttccgtcaaacgcttcttcaactaaaaggctcttacgcaattgctcttttcgataacgaaaacaaagaaacaatctatgtggcgaaaaacaaaagcccattattggttggtttcggagaagatttcaacgttgtcgcttctgacgcaatggcgatgcttcaagtaacaaacgaatatgcggaattaatggataaagaaatggtcattgtcacaaaagacgaggttatcatcaaaaaccttgacggtgatatcatgacacgtccttcttatatcgctgagctagatgcaagcgacatcgagaaaggcacatatcctcactacatgttaaaagaaacggatgagcagccgcttgtcatgcgcaaaatcatccaagaatatcaagacgaaaacggcaagctgtcagtcgctggcgatatcgcaagcgcagtagcagaagcagaccgcatttacatcgtggcttgtggaacgagctaccatgcagggcttgttggtaaacaatatattgaagactgggcgaaagtacctgtagaagtccatgtagcaagtgaattctcttacaacatgccgcttctatcgaaaaagccgttgttcatcttcctttctcaatctggggagactgcggacagccgtgctgtacttgttcaagtcaaagagcttggtcataaagcattaacgatcacaaacgtaccaggatctacgctatctcgtgaagcggacttcacattgcttcttcatgcaggaccagaaatcgcagtggcttcaacaaaagcctacacagcgcaaatcgctgttcttgcgatccttgcatccgttgcagctgaattaaatggtcaatctcttgactttgatcttgtgaaagagcttgggattgtggcaaatgcaatggaagcccttgtcgatcaaaaggatgaaatggaacaaatcgctcgtgacttcttcacagtgacacgtaacgcattctttatcggaagaggacttgattactatgtgtgccttgaaggctcactaaaactaaaagagatctcttacatccaagcagaaggatttgctggcggagaactcaaacacggcacaattgctttaattgaagaaggcacaccggtcattgcccttgcaacacaagagcacgtgaacctcagcattcgcgggaacgtcaaagaagtcgttgcacgtggtgcaaacccatgtgtcatctcactaaaaggcctagaagacgaaggcgaccgtttcgtccttccagctgtacatccagcacttgcaccacttgcatctgttgttccattacagctgatcgcttactacgcagctcttcaccgcgggtgtgatgtggataaaccgcgtaaccttgcgaagagtgtgacggtggagtaggttttaaataaaatctgattttttaaaaccctttagatttaattatctaaaggggtatttttgtgtctaaagaactaaataaaatgaaagatagattcgataagatcgtacatgttcaagggagcggaatcgttatgagtgaatatttaaaaaaggagaaacggggaattatttttttcttcatcctttatatcgcattgtttataagctcttatttgttgattggcgggcctcctaccgtcgaaggaccgatttgtgtatttctaggattctgtttcgttcaatttcataaatatagagccttcaaaaaagatgcaggtaataaaaagggaataggcatactaagagagcagcatatagagaaggccatacagcttgaatattttaaaaagaaagcgagaaaaacacatgaccaaacctaaaatctatacaatgagctttgcaaaagtctatcctctctatatcgcaaaggcagagagaaaaggacgaacaaaggctgaagtcgatacgattatttgttggttaacagggtacagtccggaagagctggaggaacgggtggatcaacagatagatgttgaaaacttctttgcggaggctcctgagcttcatccttctcgcagtttaatcaaaggagtcatttgtggtgttcgagtagaagacattgaggaagaaaccatgaaaaatattcggtatctagataagctgattgatgagttagcgaaaggaaagacgatggaaaaaattttgcgaggttcatcatgaccatcacaagcaagcccagtgaataaccttcactgggcttttttatatttatagaccattcgaccaataaaaataaaatccatttgaacgaattccctcttgatgtcgtcaaaagaagtgatatcaaaaacaaattggcgtttgaaaagggagtggcgtgatggacatgaagatgattttacctctcattttgctgcaagccattttaatggtgattggattgtttgatttgctgaaaagagatccatcgagaatcaggggagaagtgaagtgggtttgggctttggtgattgtatttgtggcgagtgccggtcctattgcgtatttcatttttggccgtaaacaatcttaaaaggggggattcgcttgaatatgttggagtgtcacgggctgacgaaatcgtatggtcggcatgaagtgttaaaagatgtttcgttttctgttggggaggttggatgtgtcggctttttaggagccaatggagctggtaagactacgacgattcgaattttgacggggcttgcttgtcctacgtctggtgtcgtgaaggtggcgggtatggatgtgacaaaagacatggatgacattagtcatgtgattggctattgtccgcagcagcctgcattttatcaagatatgacggggcaggagtggatgcattgggttggcgggttatttcatttagagaaaaacatcattcgttccaaaacagaggagcttttgaagctttgccgtgtgtatgaggcgaaggatcgcgttattggcagctatagtggaggcatgaagcagagacttgccattgcgcaggcactgatcaacagcccaaaagtcctcatcctagatgaacctgtgtcggcacttgatcccatggggagaaaagacgtcctgacgttgattgagcgtttaaagcatgagatgctgatctttatgtcgacccatattttagatgatattgagcgggtggcggatcatattatcatgatcaacagcggcaaaattgagatgtcctcttcgatgaaacagatcaaagaagactatatccagccagtgattgaatttcaattagaacaacagaatacgaaattagtggctttgttaaaagagcgggattgggtggaggaatgctttgagacaggagaggcttatcaggtgcgagtgaacaatcaacaaagggcattgaaggagttgcctcgtctgatcactgaatctggcggtgttctcctccattatcgcctatctgagctgacgcttgaagatattttcatgaaggttgtgactgcatgatgatgttgaaaaaggaatttagggagttattcactagttataaaatcttatttgtgccaatcatttttacgattttaatgatcacacaacctattacgctcaaaatgctgccggatcttttgtcgaaatcagctaatttaccagaagggtcttcattttatataccagagcctagtgctggagaggctttagccagtgctttgagtaaatttgattcgcttggcgtgtttatcctgattatgatcgtgatggggacgatcgctggtgagcgtgcctctggggtgacggcgatgattatggtgaaaccgatcagtcgaacgagttattatgtctcgaaactatgtgcctatgcttgcttgactttgtttagtttggtggtggcgatgcttgtctccgtttattatgtggacattcaatttgggcatctggattgggtcaatgtgttaaaaggaacacttctttattatccaaatttattgctcattgtggtatcgaccatttgtgcttcggcgttctttcaacgttctgtcacagctggcggtgtgtcgcttttgatcaaccttattttatttaccgttccttcattttatgaggatacattagggaagtttgcaccgaaaggcgtcacaagtgcggctgaggagatgattcatagagggacttattcggatcaggcacttacaagctttctaggtgtatcggtattgattggtttcttttttctcattggatggtttctttttagaagacaagaattatagcaggcggttgcgattgtttcttcaggtttactatgagcataaaaatctgaataccgttgaaagtttgataagatgataaaaattgactgtattttcagaaaaggggtttttatcaatgaaaacatcacgtaatccggaggccattcacccgccagttgcaccctacactcatcaaatagaaacaacagggccgcagcggtggttaactttatcggggcaagtggggatggaagtcgatgagaacatctcagcaagcccgatggaacagctcgagctagcgttagagaatgtaaaacgaaatgtagaagcggcagatatgaaagtagaagatataacgaagctagtattttatttggtaggtgagtttgatgccgagagcagaaaacgaatcatgggtcagtttttaggggatcatttgccttgtatgacgatgatttatgtggtggctttggcttctccagctttaaaggtagaggtggatgcgtgggcgtgtcgggatatggattgatgaaatggttgtttatatcagttgaatatgctaaaaattgtataatagagttttaaaaaagaggtggttttttgtttcaatcaaatcaaaaattgaaaaaagtgtggtcttttatgcaggtgttggagctgttttgctgattctcatgctgctgaaatggctgccgatttctgccgactgggagttgccattgattttgttcgggttggggattttgttttatgtgaagcgtgtgctttggaaggaagaaaaaagtcataacacatgagtttctgtctaggtgaatctagaaaggtggagttgattaaatggaatgaataaaagattggattcaacattcaatcttttattcatttttttggaaatgcttttactgctttagagcagtgtttgaatcaaatttctctaaaaattcaatgtcctccatgtatttaaaatagcgtttgatcaaatggttatccatttggggataggtcattccatgtgcttgtagaaccgtttgagtatttgttgagtcaaagtgcgccatgttttcgtagagttcccagactgttttgtctcgttctaccttttcagagagcattggaagaaatggcgtaagggcgttgtctgcatgttggtcgcttgctttaatgagtgcttctacccaatcgttatatgatatcttttctaatggatagcctatttcttctgttattttttgaaaaaactcacctaattccatgctttcttcttgaggtgggacgagatgataggctttgccgaagttggctgggtctttgcatatagttgtaatggcttttgagacaaagtcgacgggtacgaattcttttcgttgattcggtagctcaccgtaagcctttaactggatgcatcctttgatcagccttgccatgtaatcctctgtattattaacgcctgtttgactgtcgcccatgatgaagccggggcgaagaactgtgataggcactccgcgtttttttgcttcccacacgcgtttttctgcgacccatttgctttgagaatacccaatgtccttttctacaataggaagataagcatcaatggatgtatcttcaaaaagaatggtcgtcccatctagatacccggcaggcccaaatatggcaatggtcgataggaaatgaataggctttacctgttctgtgcaggcgagtttgatgatattttcagtgccggtgacatttgtatccttgtgcatgtgatagggctgaacgtaattgacttttgctccattatgatagatggcatcaatggtttgggcgagctgttgaaattcatcggttgatagtcctagttggggcttgtccaagtaacctacaatcggctttaggtgtttcagataatgttcatcccataggtgatatttctccatatttacttgtattctctgtcgtgcgtgctgcttgtctcttgctctgacgacacaataaatttgaatggtgggatgcatctgaactagttctttgatgagataagcgcctagaaagcctgttgctcctgttaataacacggcattctgtttaaatgaactagatttgaatgggtgtgtaggctgaatgtctccgtctaaaaagccttctgatttgagcttttgtttcgtctgaggagtttgttcttgtagcaaacaattcattttttttatggtgggatgctcataaagggtgctggcaggtaattcaacgtgtaatgtttcctgcatacgcattaaggttttggcagcaaggatggagtttccccctaagtcgaagaagtgatcgtttgtgccaatgggctctacctttaataggcctgtccatatttcacatagtgcttcttcgatttgattggtaggtgcgacatattcagtttgcaggctgggcctgtcgaaatgatatcttggcagtgcttttcgatcgactttcccattcgtcgtcgtagggaaggctgtcaatagtacataatgtgcagggcgcatgaaatcagggaatgtttgctttgcataagattgaatggtatgtagatcccatgtctttttgttgaacggaatgatgtaggcaatgatgcgtttatccccaggtgtaacctcagtggctgtcactaaacaggatttaacacttgggtgcttgatcagcacatgttcaatctcgctaagttcaatacgaaagcctctaattttgacttggtcatcttttctaccaacatattcaatcaggccatcaggttgttgtcgaacaagatcccctgttttgtaataggttcttccatcccgctcgatgaaacgttcttttgtcaggttttctctttgccagtagcctaatgctagtccatctcctgaagtaatgagttcccctatttgtccttgagagacagattcaccttgttcattcgtgatgtcaatgatggttcctgatactggtctgccaatcggtatactgactagctcatcccatgtgtttggtagttgaaaagttgttgtgaaaattgtattttctgtcggaccataaccattaatgatggttgtatttgggagctcttttaatgcttggtgtatgatttgaggtgacatgacatctccaccagagacgatgtatttaactgatttgacatcgttcagatgtgattccatcatcaagttgaacaatccagtagttaaaaagagaatagatacatcatagtctttaatggtttgactaacgagttcaggagtcagttttccagaaggaggaatagtgagtgtcgctccatttaataaagcggaccatatttcaaatgtagaagaatcaaaagagatggtagatagtaatgctaacgtatcagaagaattaacgggcagaaaggaaggattatgcgttaggtgcatgatacacctatgggtaatgacaacaccttttggttttcctgttgtgccagaggtatacatgatataagcgacatcagaagatttgacatcaaaggacgggtttgacgttgattgtgtaaggatgagatgttcttctttatctaagtagatggtagggataggcaacggggtcacacttgatgagacatgtgatgttgtgagtaaaaaggatagttcggcatcttcaaccataaattgaatacgttcactagggtagtgtatgtctataggcacataaacggctcctattttagtgatacccagtatagagacaatcaattgtggtgatctttctaaggctaggccgatatgagaagcttttgttacacccattttgatcagataattggcaaactggttactttgttcctcaagttcagcatatgtgatgttctgatggttgcatgctaaagctgtatgatgcggtgtgtgggtggcgtgatgtctcacgatttcacataaattttgaacattcatgatggtattccccctctagaatttgatagattaggaaccttattcctaaatccacccaaagtgtatatgaagaaatatccattgtcaatgcagagatgtgttaaattaaatgttaaattcatacaataattgaattgatgagtggatattattttcgaaatcaggaatgaatttaaggaatttgtgactttagtcttgaatgagtattgtcactataaagatgaaaattgaaacgtgagaggatggttcaaaccagtttaatgataaggtgagatattacatttttattagaaatatagttacatatttcaataaatttttggtaaaatatacaggcatatcttaaatttgttatatattttttaaggagctgtcgtgttgaagggatctagggttgagttaattgatagtttgcgtggttttagtttattaggtattttgatcgtgaatatgcttaattttcaatatgattatgattttgagaaaatgtttgattcgagcttttgggggcaggaatttggcgtttatgtaacggaaattttgttccaggggtcgttttatccgattttctcctttttgtttgggtattcttttatcaaactgattgaatccactaaggccaaggggctgaatacgaatgctattgtcgttcgccgcggctttggtcttattgtgcttgggatgctgcattacatatttatttggaatggtgacattctcatgtattacggtgcatgtatgtttttcttgctgatgtttttaagcagccggatcaaaacgatgctgatttggtcaggggtgttaggtgccttgtcattggtggttttaccatatctgatgacctttgtttatggaaatgatgatttgttaactgatgtgtatgcgaagggtgcatacggtgatattttgttgagccggattacgattgaagacgatatgatgattgtgaccattattatggcgatcgtgaccattacgctgatgccaatcttaggttttctattcggtacgatcatggtgggtccatttgcactgcttggcatggccattgggaaaaaaggtcatttgacagaagaagatcgaggcatggcttatcgtaaaggctgggttgggatgattatcatcgggctcgccttaaaatgtgcgacgttcattgatgccccttggagtgaaatggtgatgacgttaggtgcctatgtgctggcgatcgggtatattcaagcttttattgtgttttactattcgaaggcagcccaaggcctcaaacgtctgcttgcagggcttggccgtttgtccctatcaaattatttggcgcagtcgatcatttgtacaacgattttctattcttatggacttggtctatttggacagatggggtcaatgtttggactgctgctcgctctcggactgtatactgcacagctgttcatcagctatgtctatttgaaaaaatggagaagaggtccggtggagtggatgatgggaaaatgggtgtattggagataaattttttggggaaggccgcatagctgaagagctgtgcggtttttttagttgtattgcaatcaaaaaatggttgattattctcctagtgtgtatataatgtatatatagtgtatatacaatattttgttccaaacaccagtacagaaaaaaagaggtttttatatgcaaattacgatttcaaaccactctaaggagcccatctatgagcaaattacgaatcaaattaaatcgatgattttaacgggtgagctggcggagggcgcggcgctgccgtctattcgaaagctggcgaaggatttacaaatcagcgtcatcacaacaaagcgtgcatatgaagagttagagaaggcaggatttatttattcgattgtcggtaagggatcatttgttgccgagcaaaacctagaggtcatgagagagaaaaaattgaaggtgattgaggaacagcttggagcggttgttacaaacggcaaggaattaggcttatcttttgatgaattgcagcagttattaaagttcttgtatgaggagtgagatgagtggagcatgtgattgaattcaaaggagtatcaaaacggttcaaagacttttctgtgcagaatcttgatttacaggtcaaaaagggctttgttactgggtttattggagaaaatggagccggtaagtcgaccacgattaaaatgatcatgaatttgttaaaaccagattcgggtgaggttaaaatttttggattagattatcgcacccatgaaaaagagattaaggaacgaatcggctttgtttacgatgctaacgtttttttcccaggattgaatttaaaagacatcaaacgaattgtggcacctgcctataaacgctgggatgaccagcttttttatcaatatattgaacagtttggtctgccgctgaataaagcgatcaaaacattttcaaaagggatgcagatgaaggcgtcacttgcgattgcgctgtcgcatcatgccgagctgattattatggatgagccaactgctgggctagatccggtctttagaagagagctgctcggcacgttacaagaattgatgattgatggaaatcgaacgatctttttctcgacgcatatgacgactgatttagatcgcatcgcggattatattgcgtttatacaaaatggaagattggtctttcaacagtcgattcatgaggtggcggagaattatgcgctggtgaaggggagcctggatttgttggatcgagacacagaaaaggcgtttatccatattcagcgtacggcagccggatttgaagcattaacagatcggattgatgaggtgaaacttatttttggggatgctgttgtgattgaaccggcgtcgcttgaggatatcatgttttatttgaaaggcggggttgcgcatgtttcatttaattaagcgtgatgtgattttgcaaaagaagcagttacttatttttattccgtttatcttgttttttattttcatggatgtccatccagtattaacgtttctagtggctagtgtcttcattccatttaacacatatgcttatgatgagaaggcagaaacgaatatcctcttaaattctttgccttatacacggaatgaaattattgcatcccgttatcttggtgccgttttttatatggtcattgcgatcgggctgacaagtgctgctttctctagttttgggaagctgttttcgataacggatattgctcttggcagcgggttgtttttattgtttgcggcgtgtacctttccattattttatatcttaaagcctggttatatcacaacggtagtgctcattggctttattctattatctgctatgggaccgcctgttgttctctatttagcagagcaattcagtgggattactgattttatcatgaatttatcgatccctattgtatatacggggtcaactgtactgattatgctcatctacttgctgtcttggggactttctactgcgatttaccagaggaaagtgttttaaatcagatgatcacatcatttatagagaatcattcattttgaggtaggcctttcaaaatggatgattctttttttgcatccggtgaaattgacatacagaagaaaagaggttattgttaattaacataatgttaattatttttaacatattgttaaataaatcatcctttaagaaaggaatttgaaatggagattaaaaatagaattaaggtattacgggcagaaagagactggacacaaaaggatttggcagagaagttaggtgtgactcgtcaaactgtggcagcgattgaaaatggtaaatattctttgtctttaaaattagcatttcaaattgctaggacatttgaagttgatttgtatgacgtatttcaagaggtcgacaaggaggaacaacaatgataacgacgatcatactttattctctgattaccctttctgttttaagcacggcctttcaatttaagaaaaaccgtgaatataaacatgatgaacgaggtcaatttattttagcgaaagcaggaagtttttccattataggtgtggctttagcctatatattggttgctgtcgttcaatctttggtccatcaattctcatctccaacagagtggttttatatagcgattacgtttatgtatgtatcaagtgtttgcgcaaatacaatcggcatcatctattgtgaaagaaaatattaattttcatcgatggatgtaagctagagttcttcgtcatgaagggaagagaaaaccaatgaaaaaaatattgagaatcatgttgatctccataggcaccattatcacggtcatggttgtttttctagctactgtttattttgtaaacctcattagtaatgaacgggagaaagggaaaatagaagcttatgggcaaaaggtcttggtggatgggaagcaaatgaatgtgctcattcaaggtgatgggaaagaaacgattgttcttctcccaggctatggaactgcttcaccagtgctagatttcaagcctctagtagatgaattatcaccttattatagagtcgtagtgattgaaccatttggatatggtttaagtgacgatacagataaagtacggacaagtcaaaacattgtagatgagattcatgaatgtttgcagaagctcaacattaaaaagtatacgatgatgggtcattcgatctctggcatttatggattagaatatgtgaatcaatatgaaaaagaagtcaaagcttttgttggaattgacagcagtgttcctaagcaggaggatgcagatgaattgccagtttccagcttacagctgcttcatcaatccggcttttacagattgatagtgaaaatgaatccagatcaactggtgatgcctaaagtagatgatcaaacgaaagctcagattaaaatgctgactttccgaaatttcttggatgaaagccaagctagtgaggcagaaaacttcacgaataattttaaacacgcagagcgcttacatttccctaagaatctccctgttgttttctatctagcagatcaaacggaagaagaaacaccaagctggaaaccaatgcatgaagatctcctgaaaaatgtagatcacggaaaagtagttactttcaaaggcggccattatttgcatcatacgaaatcaaaggaaatcgcagctgattttagagaatttctaactaacaacgagagtcaccgttagtcatataccttcccggcatcatctagttacccaagtttattgaacaatattttcattttctcgtgttaaaaaagagaccgtgtgagcggtcttttttttatatacagaacctatattgacagtttatcatgaagtagattaaaatacataccaacagtcggtatgtaaaaaggaggcgttttatttggctagaaataaatatccagaaaagacaatcaagcaaattttagatgtgtccacgaagctgtttcaggaaaaaggatttgaaaagacgagtttgcaggatatcatccaagaattgaacatgtctaaaggggctatttatcatcatttcaaatcgaaggaagaaatattacgtgccgtgatggagaggcaatttcgtcatgcgactgagaagcttgaagatctgattaagcatacagaggcagcgcatgcgaaagagaagctgcagcgtattttagagcagctagtggcagatccaacatctcattcgattgatgggatcttggttgaccagatcaaaaatccgcaatttgtggttgagggaatgaaggcaggcgtcaatcaggatgcgcttaaaatcaaacatcttattcttgaaggaattgatgatggttcgataaagactacatttcctggggaggtggcagaagtgtttatgctactcgtcaatatatggctgaaccctacgctatttgctcgtgatgagcaggaaactagtcagcgtttactgtttttacaacagatgatgaaaggtctcggagtggatgtggtgagtgatctatttattcaaaaggtcacagcgcattatgctgggattggtggatatgatcagcctggaacctaaatggtcagataagagacaaaggaaaattcattttataggaggttgccttatgcttcacttcgtaaaactcgagctaagaaaaagccatatgaaacattatattcaagctagtatgattgtcagtattgtactgctggtgtttatttattttgttgcgtttgttgcacaggttgaacaggaaatcggttttcagcaatatccgaatatctatttgttgaccagtatagtatggatgatctttttttcgatcgtcacagccatgatgtattgtcgagaaatagtggctgcattgaaagaacaagaacctcattcatccagtatgagatcatccctcctttcgagagtggtttggatgctctgcttttctacaattgtcatgctgtgtagtatcattccttcatttgttgtgtttagtgtcactgaaacgttcttccccattgttcaggatgcgctgacagcggatgtgatgctcactgtgatcaaaacgtacctagtgtttacttgttgtatcaatggtattggcatgattgcgatgagagtgggggtcatgaaaaggtctattttcatgaccattctgactgcgattgttctatgtgctgttttaggaaacgtattaatcgctgtttatggaaatgatcaaatgaatgtcattttgtcaggagtcatgatgatagctgtcctcatagtgatcttggaattatggggccgcatgacccggattcaagcgagataagcgagtacacaaggagggagacatatggagcatacaattctaattgaagagttggtcgaagaattatcgctggattggctgctcggagaggtgtttattcaacaccatgatcatccttatctcatcattcgtcaaacggccaatcaagtgttcccaaatcgttatttgatgcatcatcaggtaagagatggacgattgttcattaaagatagacggaaaaaaatactcagcttagggcttcaactttataaaaccgatgtcgctattattctccctaaacgacaattacagtccatttccattcgttgtaaaggagcaaatcttcaggcagagagattgaaggtggaacatgtctcttgtcatttaacgtctggaaaaacgatgctatcaggtgacatcaagcatctccatttagagactgtaggtgggcttatttctagtcgggaacttaccgtacaaagattattactgcacgccacatcgtcaaaaattgagttggcgggtgccttttcggacgttgatctgcatgtaacaggtagaaggatgcagattcattctacaaacgtgctaaattcacttaaatctacttcaactggagcaaatgtcaaagtggtgataccggaaaatgatggatttacttgttatgtaaagaaaagatccggcgctttccggaatgacttttcttgtcatcgagagaaggacaaaatggtgcataaaaatggactgtgttcctttgaagttgatataaggggcggtcagttcctattaagtgatcagctttaaagtgacttacatcctttgattcaatatatcaatataaaacaatttgagtatcttcttatgtcggaatattttgataatagtgtttccctcaaaaaaacaattgttttttaagggtagatttattatgataatatacatcgaaagattgatgtttctcaatcagaatgaatattctgattttcatttttttttatgttgtttgttgatgagggggaagaaaagtggctcaaaaggaattaaaaagagggttaagtgcccgccatattcaaatgatcgcactcggcggcacgattggtgttggcttatttatggggtcagccaaggccattcaatggacaggcccatcggttcttctcgcgtacgcagtatgtggtatctttatcttttttattatgcgtgcgatgggagaaatgttatacgttgaaccaagtacaggttcatttgctacatttggtcatcaatatattcatccgcttgcgggttatatgacagcttggagtaactggttccagtgggtcattgtcgggatgtcggaaattattgccgtaggcgcttatatgaaatattggttcccagacctgccagcgtggattccaggattaattgcgatgcttattttgggagctgccaatttgatttcggttaaatcgttcggtgagttcgaattttggtttgcaatgatcaagattgtgacgattattttaatgattattgcaggtctaggcattattttctttggatttggaaatggcgggacgcctattggcttgtctaatctgtgggcgcacggcgggttctttacaggtggatttaccggattcttgtttgcattgtcgctcgtcattgctgcctatcagggtgtagagctgattgggattacagcaggtgaagcgcaaaatccagaaaagacgctgaccaatgccatcaaaagtatcatctggcgtattttgattttctatatcggtgcgatctttgtcattgtgacagtgtatccttgggatcagttgaatacccttggcagtccatttgtggcgacgtttgcgaaaattgggattacagccgccgctggtattattaacttcgttgtcattacagcagcgatgtccggctgtaatagtgggattttcagtgcgggacgtatgctttatacattaggtgtgaacgggcaggcgcctgctttcttcaccaaaatttcgaagaatggtgtgccgtattttggaacattcgctgtgctgattggtttagcaataggagttgtcctcaattatgttgcgccaccaaacattttcgtctatgtgtatagtgcgagtgtacttcctggtatggtgccatggtttgtgattttgattagtcatatcggttttagaaaggcgaagggagctgcgcttgatcagcatccattcaagatgcccctagctccgttttctaattatctgacaatcggcttcttactgatggtgcttgtatttatgctcattaatcaggatacgcgtatttctctgattgtggcaattgggttcttaattgtagtagcgcttagcttctatgtttttgggatcgggaaacggaagccgattgaaacagcttcttctgatcaaacggtaaaataatcaaaggccttgcggtccatcccgcaaggctttttttgtttagagtgaagcttttacacggttaaagacatctggaaagttggtgaacagaccggtgacgacgtattgcattaaacgggtcatgtcggcttcgctgttgaccgtataggggtggaggaggagtccgtggcttctgacctgttgtacgttttcaagtgtcaatgctctgaaattcggtccgacacccactgcataagatttgatgaaatcgagctgatcatctgtgatgaacgtcatttgggttctgtctaaaagctgtacttttggaaggcgcggagctaatttctgtagctttagcaggctgtcttggctaaaggattgaatgatgacctgcccttttcttgtgtgtttcccgagaagatgatgtttttttagggtcgccaatagcttttcttccatttgcggatagatgtctggtttttttgtttcaatataataattttctcgtttgccaaaatagcgcagtacttcatctaatgtgaggactcgctgtccgatatagttgacattttgtctgtcgggattggcttcattaaaccatgtaccagcgtcaagctgtttgatttcagcaagtgtgaggtctttgacccagcccgttccgtttgtggtgcggtcaacggtttcatcgtgcatgacgatgagatgtccatcctttgtcatttgaaggtcgagttcgaggtaatcggcattcatctttgtggcgagtttgtaagaagccagggtatgctctggtgcataccctgatgctccgcgatgtgcaacggttagaatacgatctggagataaaaggttttcatgtgccgatacggtgaccggcacccatgcaatagacagtaaagcaaaagagagcaacacgaaagcaagtaatctacttttcttcatattttatcctccttttacggtaactgccttcatcataagaaatagatgtaaagggcatattgggcggatatgaatcttttatgtgattttcattaagcttgctctacgcgcttccctgtattccaagtcatcgctaggaagacaatcgcaagcacacaagaactaaccaataaaataaagcctcctgtccagtcgtaatggtccacgacgacgcccatcatcgcatttgcgaaggcagagccgccaatataaccgaaaaatcctgtgagtccggccgcagtgccagccgcttttttaggagcaaggtcaatggcttgaagtccaatgagcatgacaggtccgtaaattaaaaagccgatgctgatgagggcgatgttatcgaccattggattgccagcagggtttaaccagtatacaagcaccgcgattaacacaccagccataaagaggacgcctgctggtgcgcggcggcttctaaagaatcggtcactaatccacccgcacaataatgtgccgggaatgcctgcatattcataaagaaaatatgaccagcgtgaatgctctggtgaaaagccctttgcttctgttaagtaggtcggcgcccagtccacgacaccgtaacgaacgaagtacacaaagacgttggcaatggcgatataccaaaggaatttattgttgagtacatacttaaataaaatctctttcactgttaattctttttcttgatcttcgtactgctgtgccggatagtcattgcgatattcctcgattggcggaagaccagcggattgcggggtatcccggacgagaagaatgatcacgaaggagacgataatggcaatgatggcagggaagaaaaagatacttttccacgtcgcaaacagcacgatccctaaggtgatgagcggtgccagaattcccccgccgatattgtgagcgacgttccaaatggacattttcgttccacgttcactaaccgaaaaccaatgcgccatcgtccgtccgcatggcggccaccccatgccttggaaccagccgtttaaaaacatgaataagaacatgatccatacacttgacgtcacccatggaaatgagacaaataggatattgataagggctgatagaaagagtccggtggctaaaaaatatcttgggttacagcggtctgagatcatacccataatgaatttactaaagccataggcgatagacacagctgcgagtacaaagcctaattcacttttcgtgaacccttcttcttgtagataaggaatagcaaaagcgaaatttttccgcagcaaatagtagcccgcatacccgataaagatgcctaaaaagacttgaagccgcagccgcttatacgtctcatctgttttggcatcatcgagcctgtcgatatgcggagcgggtttaaaccatttgaacataaagatcctcctcttgtcgttgtccgactgactgaatcaaaagtacgagatcggcgtttgatcttgtactttttaagagacaaaagaattgataacgctttcttttgtactcccatcatatcggatggaagagacgtttatgatgaggcttttgtcattattttggaaaaacagttcatcaagtaacgaaaaaaatccgcacatggcggattttccttagctgttacagagacacattaattttcgcagatttcttaagcttttcaatttctttttgaacttctttctgcttttcttgggattctagctgctttttaatttgtgatttaacttctttgtactctggtgctttttgcttttgttttttcatttcatctgcgtattgatcatagtacgctttaacatccttttcagagacggacgctgatttgatttctttgtcgacatactggctgtatttgatgctgtcagcaatgtcacttttcagctgatccatggtgagtccgcttttcttaagggcttcttcaaactgagcgttgtctttgaattgtttcttttcttcttttagctgtttatctacctgtttgtcagaggctttaatgcccttcttctcagcatcttgcaggatgagctcttgacctacgagcgcatcaatggtttgtttcttgactgcttttgcgccttctttagatgttgggtcttgcccagattgctgaagctgtccttgaatggttgatagagcgctattatattcattacctgtgattttgtcttggttgacggtcgcaacgaccttttgatcatcgattttttgtgcgtctaatttcttttgcatctcttccatttgcttttgctgttctttttggtcagcctgtgttgtttccttgtttttggctgaatcgttttgcttatcttgtttggcatcgtttgacgagcaggctgcaagcccaacagataacaaacatgcgatgagtgtgtatgatacctttttcatcattttctctcccttcggtatgagaacatctagtgcgcattctaaccgttttttaggaaaaataaaaccgtacagacaatttgttagcggattgacatgttttttatctgtttgtcctcattttgtcttctcatagtcatctcatgacaaactcaatcgtggaataattgttccatcgcttcgtcgagattggtgattggctggcggcagctgtagttttcacaaatatacacggtggttttgccatcgattgttttgtaatcttttgtaaagggcgcgagcttcgctaattcttcccctgtttcggcagtcaatatgatatcaaatggcatgaagcgtttttgaagcgcctgtaaaagctgttctttttgagggtcgccgttttttccgagaatgatgatttctcttttcgttgcatattgagcaaggagtccttgcagaaacgctgtgtgcccgcttggataggaagagatatcgacataaaaggctttgaacattaactctaatgtgtccagccaatcctgacgtccggtcaatctgcttagcatgagaaggtgcttgagtgcggtgctgttgccagaaggcatggcgccgtcgtacacttctttttctcgaacgatgagcgcttccgcatctgaacctgagaagaaaaagccccctttttccttgtcccaaaacagctcaaacatgttctcggcaatggctgtcgccttttccagccatgctaattcaaaggtcgctttgtataatgacatatacgcttttagcatatgcgcataatcctcgataaagccaagatgctttacgtcaccttctctatatcggaccatgagccgctcatgttggacgaggtgtgtttctagaaaagacatcgcctgtttcgccataccgatcgcttcctctgcatcaaatactcttccagctttggcgagagatgagatcatgagcgcattccaggatgtgagcaccttgtcatcgataagcggtgcaggtcgctgctgtctgacagattgtaaaatgtgccgagcttcttgcagcttagactgaagcgtatggtcatcaattgaaaaagaggctttgatgtcatcaaaagaggtggaaatggtatgagggatgttcgccccttcaaagttcccctcatctgtgatgtgatagacagcgcagaataatgcgccgagatcctcgcctaaatgagtcatgatctcatcttttgaccagacgtaatattgcccttctttcccctcagaatctgcatctatcgctgaataaaaggagccatccggattcatcatatctcgcttgataaagtgaatcaggcggtggacaagcttttcatatgcaggttgttgagtgagctgatacgcttctgtgtaagcctccatcagcaaggcgttatcatacagcatcttttcaaaatgcggcacaagccatttttcatccgtcgaataacgagaaaaaccggaaccaatatggtcatatataccgccatttgccattccatctaacgttttcgtgactgcatacagcgcattctcctgtcctgtccattcgtaatagcacatcagaaatgagagcatatgaggtgcagggaattttggcgcggaaccgaatccgccgtgcagcgtatcaaagctgctcatgagctgataataggctttgtgaattgcttcttgagacagcgtgttttctgtctgccctgctgctttaatccgcaagttatttgtcgctttctcagccaatgattcaatatgatcccggtcgttgtgatacgcatccagcagttgtgtcagtgcctcgataaagccaggacgtccgtaagcactcctttttggaaaatacgtccccgcataaaaaggcttttgatcaggcgtgacaaacacgttgagcggccagccgccttgtcccgtcatcatctgacaaacagacatatacatagagtcgatgtctggacgctcctcacgatcgactttaatggaaatgaaatgctcatttaagatgtcagaaacttgttgatcttcgaagctttcgtgtgccatgacgtggcaccagtggcaagttcctttggctatccatacccaatcgatacgaaaacaggtttgttttcaagtttcgcttttttaaatgcttcatctgaccatgtgtaccagttgactggattatatgcgtgttggagtaggtagggggatttttcagcgattaatcggttgggtatttttttgtttggcatgggatcaccttctttcgtatagaaaaattattatttaatcaattatgtgcgatcttcctaattttataaagtaattccaacgataactttcctgagggtattctttacttaaatctttgcatattatgtctaatagcgtgaaagttcgtgaaagttcttctataagtaaaattccaataaaatttactgaaaaaaagcagtctaaaagcaaaaacgctatggaaattattatcgatgttttcaatccatttaagcaactcaaaacattttttcctacggttaccatgtactctgatagcaaagttagaaaaattatagagattgtcatcaattgcactaacaccgcacttatttagaatctgataaaagtgaaaatgaaatattatatcttctgttatttcaggcatttttatttttaagtcattagatattttattaaagtttttgcaaaactcgtacaataatatgaatttcaagtggttggcttgtatccaattttcacactggtggaaatttcttgtgatatgaaattgacttattaaatcatgttcagcatattttaaattttgactaatgattttcattattccttggaatttttcatttggatcattaagtttgtgaatttcttcttctgtaactctatctaaattcataagtttacttttataaataaagaaacgatattcgtgaaatgtcagctaaaaaaaattaaagcacatgattaaggtctaatttctttaccgatcgttctcaaatttgatatacttcaaacatgttagatctaactgttttgctactcaaaagagaatgatcattctttaattatttcagaatgagggagggatgaatgtataagattgtgcttctagtacatcaatgattctcagtcctttccctgaatatgttcgaaggtgggattatatggctagaaataaagaatttgatgaaaagaaggcattaagaaaagcaatgattcttttttgggaacagggctatgaaaaaacatccattcaagacttggtggatcatatgggcgttcaccgcagaagtatttatgatacatttggcgacaaacatactttatttatgcgagtcttaaatcattatgtagaaataatggaaggccgaatgaagaatgaagtgaaaacagaattaacagtgaagcagtcgatacgaaaattatttgaaatggtgattgattcgacacaacagcagccaaaagggtgtttagctgttaatgcagctgttgagttatccctaattgatgaagaagtagcgaaaaaaacgacagagatttttataaatacagaagccttattatttgatttgctaaaacatggtcaagatcaaggtgaaattcctaaacacaatgacatcaaagggctttctcaatttattcataattcactcgtaggaatacgagtattaacaaaaacgacaaatgataaagagaaattagaaagtattattaatttcactttgtcgacactagactaaatctattttgtgatatcgattagttaattaaaaatatggtttcgaggagagaatgatatgaaatacacagttattacaggagcaagttcaggtataggatatgaaactgcattggaatttgctgctcgcggcaaaaacttaattattgtagctagaagattagagaaattagaagggcttaaatcagtaattcataatataaatcctgatttagatgttattattcatacaagtgacctatcgataacagatcaggcatacacactgtataacagtttaaaggagtatcaaattgagacgtggattaataatgctggtcttggtgaatcttcttctgtgacggaccagaatttagagaaagtagaatccatgttacgtcttaatatagagtcgttggcgattctttccacactatttgtgcgagattattctcatgtagagggaacacaattaattaatgtatcctccgcacttggatatgcgacttatattggtggtattacctattctgcatctaaatattttgttagtgcatttacagaagggcttgcaaaagaactagagcttaaaagtgcaaaaatgaaggcaaaagttttagcaccagcagtgactgaaacagaatttgagaaaactgcacaggatgtagaagaatttgattacaaaaactttatgccaatgtatcacacagctaagcaaatggctggttttatgatggaactttatgacaacgataaagtcgtaggtattgtagatgaaagctacaatttcaatttaagagatcaaatctatccaatactaggcgtttaatgtattaacagaaaataacgtgttgggggtggctgataaacataggttctttgcagtagcgattcaaaaaatttaattatttgagaatgatcgttctaaaaaaacagtaccaattgaataaaaagataatgttgtgagtatttaaggtttgggtggtgggttgatcttaaaataaggttccctccacctaaacgattggaataatataagatctttataaaaagaattatattgagggtagaaaaatgaagtagacagtgaaaataataaaaataaggtaaagaaacttaattaaagcaactcaacggaagggtgctaataaaaatggaaacactcatgagagcagctcagatcaccaaatattcaaaaaaaccccatgtccaaattaatgacattccaattccagagatcgctgacaatgaagtcttggtaaaggtcaaagctgcggcggtcaatccactcgaaatgttaattattacaggtagcgtgaaactgattcaagattatgaattcccattaacgcttggtaatgaattgacaggtgttatcgaaaaagtcggaaaaaatgtgacagaatttcacgtaggagatgccatctatacacgtctccctctcgaaaaaattggtgcttttgcggaatatgccgcaattgatgctgccgcaatttcacccatgccaaaaaatttgtcttacgtggaagccgctgctgcaccactggctggactcacagcgtatcaaggtctacatgaagaacttgaggcacagtcaggtaaatctgtttttattccaggtggatcaggcagctttggtcaaatggcagtaccaatcgcaaaggcaatgggcctaaatgtcattgttagtggcagctcagaagcgcgcgaacgcacattggaaatgggtgcagtccaatatttggattatacaatagaaaactatgttgacttgttgtcgaatgtgaattacgtaattgatacattgggacctaaagaatttgaccgtgaattgagtataatcaaaccgggtggaaaattgctctcccttcggacaggtccgaataaacgtttcgggaaagatcgaaatttcccaagatggaaacaaatattattttctcttgctggtgcaaagtatgaccgcaaagccaagaaacaaaacgtggaataccattttattttcgttcgttctgacggcgcacaacttaaagatattacaaaaatcattgaagaaaacaacattgttccagcgattcatcggacattatttaccatcgacaacgtaaatgaagcgctaaaactagtcgcaaatggacgaccaaaagggaaagtgattattcaattttaaggggaatatgaagaaagcagtcaaaagttgagatcatttatgtaaatgtaaaggattttgaaacaaaccgagagttttgctgaattaagaaatggaaaagataaaaagccaggtcagatcatagaaaaacttcagcaagtcggagtcctgtatgataaaacatggagaactaaccatttcaaaaatgttggaatgaaaattgagacagatggttattttaaaagacatgccacaagtggcaagtggcatagccaatactgacaagcacgggtttattttcacgcttggctttgtcgaaggcttcttgcccccacgggtaccagtgaactgggttgtgagcgtgttgaaggaggtatggtgatttttccgtgatgaagtgggttgggtgtttggttgtttggcatgggtcacctgctttctaaatgttttttcgtattttcttttctccatttaatatatcagattgctgaggcacgtcataatttgtctgtgaggtattcccaaaatgaaaaaacaagggctataaacccttgatagattcattacttcatcttttaactacttcaatcgtaatgttttaacaagatggctgaattatgtcctccaaaaccaaaagaattggatagcccgtatttcaaaggaagctgtctcgcttctaatacaacgtctaagttgcaatctggatcttgcttctctacattaatagtgggtggaatcattcctcgtctcaaactttccactaaagcaatggcttctactccaccggcagcaccaaacatatgcccagtcattgacttgttcgctgttgttggaatttcacgggaacgttcaccaaataatgtcttaatagctagaacttctgaacgatcccctacttgtgtacttgttgcatgagcgctaataacatcgatttcatccgttgatatatttgcacttctcaatgcttttttcatggctaagtaggcacccttaccttctgggtgtgatgctaccatatggtgagcatctgaactagctccgtaccccacaacttcacatagtatcggcgcatctctaagaatagcgttttctaatgattctaatactaagatacctgcaccttcactcataacaaatccatctctatctgtatcgaatggacggctggctcgacttggatcttggtttctagtagatagtgcatgtgcgtttccaaaactagctaacgatatctgtgagacggcagcttctgctccaccggcaaatataatatctgcatcatcatttcggatcgcattgaaagcttcaccgatagaggtgttcccaatagaacaagcagtgactggtgacattgatggcccttgtgcccctaattttatgctgatttgggcagcagctgcatttgaaatcatcatgggtacaaggctggggcttactctcgaggggcctcgtttatctaatacattcacgttatcaacaagcgattggatgcccccgattcctgaaccaacatatacgcctaaacgttcaagatcaacatggtctaactgtaattttgaattttttaatgcttgttcggctgctgctaaggcaaactgactaaaacgatctaatcgttttgcttcttttctccccaatatttcatctgcatcgaaatcacgaacgattccagctatttttgttttataatcagtcgtatcaaaagaatcaatgagagatattcccgattgtcctttcactagttgattccaaaagctatctatatcatttcctagtggagaaataactcccattccagtaatgacaactcttttcatgatcattccctccttgttattattaactttagccattgtgttatcctattacaagttgttgtttatcctagtataattaataatattttaaagggagatcttcatgaaacctgaaacaagacttcaagcactatcagaatttctaaagaatcagcgttcaaaaatcacgcctcaaatggttggtttacctgtaggaacacgcagaagaacaccaggactcagaagagaagaagtggctcaactagccggtgtgagtcttacttggtatacatggttagaacaaggcagagatataaaagtatctacttcggtattggatgctatttctcgagcattacaattaaataacgatgaaagaagatatttgtacgctttagcgctagaggaaggtgtgaaacaatcctttatcattgaggatgagaaggaaatcagtccggctttagtgaaaatgttgcaggaacttcgttattgcccaacgattatttctgatagaagaagtcagattgtggggtggaatcaagcagcagctaatgtctttttggactttgaacagatcatcccggcagaaaggaatatcatacgcttactattcgcaagaaaggaatttaaaagtttagccgtgaattgggagcattttgttagaggatatatcgccatatttagaacgtattatggacagtatgtggctgatgactggtatgagcaatttatagaagaaatggagcaggcatatcctgagtttcgtaaaatatggaatgaaaatgagatcagctatgcgcctgaagtattaattgaatttcgtcatgctaaggtagggaaaatgttgtttaatctcacttcattacaagtgtatggggatactgatttaagatgcagtgtctatactccagttgaggatactgaaacggagctaaagttaaaacgtttaatcgaaggctagctattgtttggagtgtataattgatttgagggatacttcattaattttctatattttaaataaattaagtatttatggtagaaattatttcgtgctttttaaacttaatcatgacatttagcttctttgtgtatcgctgattgagacatgccgtctattcgcttatctcatacaaaataatgggaacggagagataaaatggattatgtttatcagaaaaaggagaagaaaaacggtaattgtgttatttccgttagagatagatgggagaattcaataattgaatttgaaaaaaagcaacatcatatcgatatagtggttaattaccgtaatgataagacaacgaagtattcaataccaatagagatttttgaaaaagtttacgatgatctgcaaagaggtaattgaggggatgtttgggttccttcaactacctccgcgttaaatgtatttcactttttttgatctttgcttaaccaatgtccttcagccataaacttcataacgcttctaaaaactttaataacacatcattttgaagttccatgtcgactatcctctacttcttcaccaacacatattgtaagttttctaattcaaacatatcaatcagttcatcgatccctttaaaattgatgtgttttccaaaccgttttttgcttaggtcaatttctacatccaattgatcacccttttctttcgtttcgagttcatttagacaagaatagatttcgatggtttctcctgttgacagctctttttcaatgaattgaaaaagtgcacgaagagaatgaatgatttctaattcataaacaaaaggatgcgtgaatttgtttcttaccgcttcatagaaaggatctagataatcaatgtgaatgccttcgaaatcctcttctgtttcaaatacttctatcaaaggatcttctttttgataggttttgtgctttttttgtattttatcaaacaattcgatattgagttcagagagtggtttataggtaggattttgaccaatggtaccaagcggcagttctttgcctgatccaatataatgctgtaaagtcatgggttgccctcttttcttcaatgatttcttattcgttgattatttactttttatcaataaatggtggaatgtgcaattcttttcacattcgttttctataaaagaaaagggcaagtcgtttgactaaatacctcttagggtatactatctgtcatagaaaggagtgcttaaattggaatataatcagcagatgaagaatcgtcttcgccggattgaagggcagattaaaggggttcttgcgatgatggagcaaggcaaggattgccgcgaggtggtcacgcagctgtctgcatcacgtaatgccattgatcgggcaatgggtgtgattgtgagtacaaaccttgagcaatgtgttcgtgaaagtcttgaacaaggcaaggatacggaaggtcttgtgaaagaggcagttgagctattggtgaaaagccggtaagaaattcctcagcctttggaggttgacggatttttttacttgatgtaatatacccttaccggtatatgtatatattttttattttctatatacccctataggtaattattgaaggaggagcaaaatggaagaacagaaaaaacgcacgacgatagtgttattcagtggagattatgataaagcgatggcagcttacattattgccaatggtgcagcagcttatgatcatgaggtgaccattttccatacgttttggggactgaatgccttgcgtaaggatgagatggtaccgatgaaaaaaggatttttagaaaaaatgttcggaaagatgatgccgcgcggggctgatcgcatggggatttccaagatgaattttgcgggaatggggccgaaaatgatcaagcatgtgattaaaaagcacaatgccatgaccttgccgcagctcattgagatggcgaaggagcaggatattaacctcgttgcatgtacaatgacgatggatcttttaggattacaggagaaagaattattggatgacattcaatatgctggtgtggcggcatatttagcagaggctgaaatcggacgtgtgaatttatttatctagtgaggtgaagcagggtgcagacgattttactcatcatcgtaattggattgctcgtgagccgctttctgccggtacgaggtgtgaagcaaatggatgcagctcatatgaaaaagaaggtgaaaagcaaaggtcaacagctcattgatgtgcgatcccccagtgaatttcaaacaaatcatatcaaaggctttcaaaacatcccgttgtctcatttgaagaaacgagcttctcagcttgagaaaaatgaagaggtctatgtgatatgtcaaagcggaatgagaagtatgcaagcagcgaaaatattgaagaagcagggatttactcagattacaaacatcaagggtggcatgaatgcttggcattaaatgcgcaataaaatatacccccatccctatttaaaggaggagaagacatgcagcaaccaactgtcattttagatgcaaaaggactggcatgcccgatgccgattgtaaaaacaaaaaaacaaatgaatgagctcttgccaggagacgtactggaagtgcaagccactgataaaggatcagcagcggatctagcggcatggtcaaaaagcgcaggccacgaatttttaggaacaaaagtagaaggccaggtgcttcatcatttgattcgtaagggcggagaacaagagaaagaagggaagtccatgatttcggaaatgtctttggagacttttcaacagaaagtaaaagaagatccatctttgtttattttagatgtacgagagctggatgaatacgaggcggggcatattccaggagctgttcatattcctcttggtgaggttgaacaacgtgcggaggaattgagccgggagacggacatttacctgatctgtcattcaggcagaagaagtgaattagctgcgcaaaagttaaaagaaaaaggatttcatcaattgatgaatatcgtaccaggcatgaatagctggacaggagcgattgaaaaataggagctgaatgaaacatgacggtaaaagcgatgactgcagaacagttaacaaaaaagatcgtgaacaaggagccgctctttttactagatgtgcgaaatcaagcggatgtgcaggattggaagatcgaaggggaagcaatcgttcatatgaatgtgccttattttgatctccttgaaggagtagagggtattttgcatgacattcctcatgatcgtgaagtgttggtggtttgtgccaaggaaggctcctctatcatggtcgcggagatgctgtcagaggcgggcagaacggtccattatttagaaggcggcatgaaggcgtggagtgagcatctggagccagtgaagattggtgatttaagcggcggtggagagctctatcaatttgtacggatgggcaagggatgcctgtcttatatgatcatgtcgaacggagaagccgcaattgtagatgcagctagaatgacagatgtttatatccgttttgctaaaaagcatgatgtctctatcaccgaagtgttggacactcatcttcatgcagatcatatttctggcgggaagaagctggctgaacagactggtgctagctactggctgccgccaaaagatgctgaagaagtgatctttgaatataaccatcttgaagaaggacagcgcataacgattggagcggcttccattgatattcatcctctttactcaccggggcatacaatcggttcaacatcttttatcgtggatgatcaatatcttctttcaggtgatattttgttcgtggattcgattggaagacctgaccttgcgggaatggcggaagactgggtaagtgatttgagggaaacactttatgagcgatatggagcactttcgaaagaattgattgtgttgccagcgcatttcatgattatggatgaaatcaatgaagacggaagcgtttggaaggagctaggcgttctatttgaagaaaatcatggactgaatatagaagatgaagccgtatttagagaaatggtcacgaagaatctacccgcacagccaaacgcttatcaagacattcgtcaaaccaatatggggaagctgagcccagacgaagaagcgcagcgtgaaatggaaattggtccaaaccgttgtgcgattcggtaatgtccaataaaataagaggagaggaacaatcaaatgacatcagatcaaatgttagacgtaacggggcttgcatgcccaatgccgattattcgaacgaagaaaaaaatgaatgacttgacggagggtcaagtattagaaatacatgcaacagataaaggggctaaagctgacttagcagcatgggtgaagtcaagcggacatgaattgatcacgcagacggaagaaggacatgtgctgaagttctgggtgagaaaagggtcctaaaggatgtaggggtatctgctgaagatccccttttccttttgcaaaggaggagaccagcgtggattttacgtttttgattacactttttatcatcggatgtattggttccttcttatcaggaatggtggggatcgggggatctgtgattaactatcctatgctactttatatccctccacttgtcggtgtgatggcactatcggcacacgaggtatcaggaattggcgccattcaagtgcttttttcgacgctcggtggggtattggcctatcgtaaaagcggatttttacatcggtcgttgattgtatatatggggagcagtatattggcgggcagcttactaggcagttatgtatctcactttatgccagagaatgggatgaatctcgtctatggattgctcgcgattgtggctgtgatcctcatgctgattccaaaaaagggacagcgtgcagatgcagagggagaagtcacttttcataaaggacttgcggcaggtatagcctttgtgattggcagtgtttccggtgtgctaggcgcgggcggagcatttatattggtaccggtgatgctgtctattttaaaaattcctgtccggatgacgattgcttcctcacttgcaattacgtttttatctgcgatcggtgcatcgactggaaaggtattgacgggtcaagttatgctttttcctgcggttgtgctgatgctggcaagtttaatcgccgctccgattggtgctaaggtcggtcagaaaattaatgccgtctacttacaatgggcacttgctgtgatgattacggcgacagcggtcaaaatttggcttgatttattataaagaaaagaccaacaaagcaaacgtgttggtcttttttatttgatgtcatcgtgctcaatatatgtttcaagggcagggtgatactctttttgataatgaaggttgggacatgttttcacgactttgccttgcagggcattggacttagagacttctaatgctgttttacatttagggcagcgttcggcaaaaagtgagggccagcgcttcatatatcaccactccatttaaagtcttaaaaaccgattatattaatatgaattataggggatcgtgctgatgaggtcaatgggtgtttgggtctttttaacaaaaaagaagcatcgtaaaggatgcttctctttcgtttcgattctcaataagcttttgcccaaaagaccatatcagatgcaggctttccgcagcagacacatgtgtctgaaacagattcctgttcaaatgggatacagcgtgaggtcgcccctgttctttctttgatgtcgttctcacaggcttcgtcaccacaccacatggctttaatcaatcggttttcttctgaaagaatgtgctcaatgtcttcgatcgtgtgagcttctgatgttttttcatgtaatcgttctttcgccttttcgtacattgtccgctggatgtcttcaagcgtggatgtgatggtttgttcaagtgcatctaatgcgacagcttgcttttcaccattgtctcgtcttgcgagcatcacctgacctttttcaatgtcctttggtcctacttcgacacgtaaagggatgccctgcatttcacattcgttgaacttccaccctggctgtttatcgcttgcatcgatgtcagcacgtgcgatgtgtgtgagtcgatctttcaattcgtaggcatgatcgagcacaccttccttgtgagaggcgattggcacgattcgcacttgggttggtgcaatgtttggcggaaggacgagtcctctgtcatcaccatgcaccatgatcatggcaccgatgattcttgtggtaaacccccaagaggtttgctggacatgctctagctttccttcacggtttaagaattcgatgccaaatgccttggcaaatccgttcccgaagaagtgagaagtggccgtttgcagcgcttttccatcatgcattaagctttcaaccgtataggtaaagcgggcaccagcgaatttttccttctctgtttttctccctttaatgacaggaatggcaaggagctcttcgcaaagagaagcgtagatgtgaagcattctttctgtctcctcaatcgcttcttgctctgtctcatgacatgtgtgtccttcctgccataggaattcaagcgttctaaggaatggacgtgtggtcttttcccagcggacgacattcgcccattgattataaagcttcggtagatcacggtaggaatgaatgatgtttttgtaatgctcagcgaacagtacttcagaggttggtctgacgcagagcctttcctgtaatttggattcaccgccatgtgtgacccacgccacttcaggagcgaagccttcgatatggtctttttcctgctgcagcaggctctctggaataaagagcggcatatacacattctcatgacctgtttctttgatttggcggtcaagttcgtcgcgaatattctcccaaattttaaagccgtatggctgaatgatcatactgcctctgacgcttgaataatcgacgagacgtgccttcgtgacaacatctgtataccactgggcaaagtcgtcttccatgcttgtgattttttcaacaaattgtttctttgacattgcatattcctccttttaaaaaacaaaaaagctgtgctttaagttagggaccattcctggtggtaccaccctaatttaaagcacagctttacactcgatcatgataacggtatgaaccgctgtatgaaacagaactaaatcggcaggttcacttgaagatgtcagtaggaacttctcagcaccgttccctctctgttaaaggtcaattcaagctactattccagatctacgttgatgaatgttcgttgatttttcatcagtttacctgtaaatgcaggagaaagcaagttgtactggttgttgttcagattgctttgtttgatcgtgaatttgcagtcatttcctatttttacagcttgccagttatgtaagcatatgctactatatttgaagaaaaaatagacttgtataacctcaataatatggtttgagggtttctaccaggatccgataaatcctgattacaaaagcgtgctttccttttttgtaatcagggtttttttgtttgtcttcaccctgtatcaaaagtgaaagcgatgatatagagaagggatgttagacatgaactggagagtatatttattagccgtttctacttttgcagtaggattagttgagcttgtggtcggaggcattttgccaagccttgcagaggatttgaatgtatcgcttgcgacagctgggcagcttatcaccgtatttgccattgtgtatgccatttcagcacctgtgctgctgactgccacagctaaaattgaacgaaagcgtctttatttaatcgcgttattggtgtttacgatagggaatgtcttcacatattttagttcgacctttgctcttgtcatgatctctagggtattgatcgcgatgagcacagcgctagtggtggtgttgtcactgacgatcactgctaaattggtggaaccagcgcatcgtgcgaaggcattagggctgatttttattgggattagttcttcacttgttctcggtgtaccgatcggtatttttattacagagagctttggctggagagtgatgtttttaggaatcagtattttatcagccatatcaatggtgctgatctatttcctattggagaaaatgcctgttgaaaaagtgacgcctcttagagagcaaatacgttctttagggcatccgaaaatttttagtgcacacttgattagtttgtttatgcttgcaggtcattatatgctttattcttatttcactccgtttttaatggaagtactgcatatgaccccgttctggattagtatttgttatttggtcttcgggcttgcttctattggcgggaatggatttggcggctggcttagtgacaagctgggttcagggaaagccattttgctcgtgacaatcgcgtttgcagttgtgatgtttatcattccttatacatcgggcgtgtttgtcctctttatgatcatggttgtcctttggggagcgcttagctgggcattaacgcctgccttgcagagttatttgattcaaacagatcctgtgacgtctgatattcagcaaagcttaaatacatcggcattgcaaattggtatctcaattggatcagcagttggcggtgtcctgtttacgatgaccggttcatctgttgatctggcgaaattcggtgcagtgtttgtgctgattgcctttagctgtgcggtgatttcgttgaaaagaccaccactttatatggatcgtcagcatcgtgctgaatagctgcctaatgataggcagcttcagcgtgtagacaaaccctcgcattcgttgtcagtcctgcgtgctggtgctcacgaatgtcaaattcgctccgcgccagtactcgtccttcctagacttcaaaggttttctatcacgctgaaaagaagacaaagggctaaaataaaaatcattttagccctttgtcaacaatctgtagctgcctcatgataggcagcttttttatgttctactttattctattcaaaaacaaccatttcgccgattggttggaagcctgcacgttggtaaatatttttgccgtcagctgatgcttgtaacaggacgcacttttgtttgttgtctgtctgggtcagaagataatgaaacatgtcactgccaagtccctttccgcggtgctctgcccttgtgatgacatcataaattccgtagctatcagttgcttcgagtaataagcctgttgtgaccggtttgtggtctgcatatccgacgaacatgcgaacgcgtgattgtatagtatcaagcgaaaaatgctggaaatagtcctctaaggcgatggcctccggtgactccttgaatagctcgataaagatatttttgtaatcaagcagtgtctgctcatcaactgcttctttgattgtaagcggtgaagatgtaactgggtcaatgtcttctgtctgctcaagcaacatgatcgtattgcgttcaacctctctaagctgatattcctttagtaaattggcccaatcaggatgaagcaaacgatgatccacccatgtactgaatgattgtttctgagactgcaagtgttcgatggccgttttcactttttgcggatctttgatgtgcgctgatgtcggtaatagcaaattgaatgtgtctgtcgatatatgagtattggatagaacgaagtcgtccgttgcgaggaaggttccgttcacagctgaagaaaacaggtgtatcttttcttctaattgtcgaatggcgatttgttgttcgattttcattagctcacctttttcatcaaaaattggatgacatcccccatgaattatagcaaataaaagaaagaggagctgtgacatcataggtcatctagtagaaaagtatatacaccattttcaggtctgatggcctgttctttttattacactgacatttcttttgactcctatcttaattattagtaccattttattaaccagttaagagtggaggttcagatggagacaaaagagcagattgttttaaaagcgattcaagatctgattattcatagggaaaagagaaggaatgacccaacagatccactgattaccacgactgatacactcaagcaagattggacactcacacagctacatattttatcaatgattcaagccaatccaaacgaatcaaataatacatttctttctcaacaactgaaactatcaaagcctgctattacaaaggctgtaaaaaaactaattgataaaggcatggtggactattgccaccggcaaggagataaaaaatctgtctactattcattgacagagaaaggtacgcaattggcggcgctgcatgatgaactgcatgagaaagctgtcgcgtcctacttagaatttctacagcagtttcatgaagatgaattacaagtcattgagcgctttttgaaggcatggaaagaaaaaatatagatttaaaaaaccgaaaccatcgtagaaaaggagatgatttcggttttttatatggtaaaattaacatatattggcgctattcgtgatcatgtggaaagggagggagcttctttggggaaagaaatgatggaaaattttaagaagtacgtatttatgatgccgttcgttggattgtttgtcagcttgctattatttgtttacttttttggcatcacaggagttgaaggatcaatttgggctgctactttatattgtgcccttccttttttggtgtacacgatattctgtttgccgttaagtatttattttaaagtcagtaaaaaacgctcaatccataaagaagaggaacaggcgtgattgtggtcagcgcttgtcttgctgggttgaaggttcggtataatggcagccatcgattagatcagcgaattgaagagcttgtgcaggaaggaaaggctgtgacagtttgtcctgaactgcttggcggcttctctacgcctagacctccggcagaaatcattggcggagatggatatgatgttttgcgggggcaggctgctgttgtcgatgttcatggaactgatgtcacagagatgtatgtaaaaggtgcaaaagccacactggagcggattcagtctctgaaagcaacagcggttgtgctaaaagagtacagcccttcatgcgggagccggatgatttaccaaggagagtttaatggtaagacaaaagcgggagatggtgtgacgtccgctttgttgaaacagcacgggattcaagtgttctctgaggaggatgattggatttcgttgtttctataggtgtttcgtggagagaaggaggagttaggttgaaaaagtgggtcattggtttagttgtagtagttttaataggaattggtatttattttatgatcaatgccaaaacgtactcattcgatgatgtggtctcgattgatcaacataaggtgacttcgattcaaattgagcatgatcataaacgtgttgttttggataaaaaagaagagattcaaaagctgttgaaggaactttcagatatgacattaaagaaaaccaatgaagacacaaaagcctcaaaagagtcttattggatcagggtgtatgagaataagaaggaaacatacggtctgactttctatgatcaggcatttctaacgacatataatttttctaaaaagaaagatcaaacaaacgaataccaaattgttgacgccaatcaagtcgatataggacaatatatcaaataacaccagcgaacattcatgcatgatcaatagaaaattcgggtatagtgcttggtaagcaaaaatgaagcggaggtttgtttgatgagtggattaacagatacagtcacattagcaaacggagtgaaaatgccgaagctaggcttcggtgtatggcaagtaaaagatggggatgaggctgtaaatgcagtcacagacgctcttgaagcgggctaccgcagcattgatacagcagcagcctatcaaaatgaagaaggagtaggcaaagccattcagcaatcaggtatctctcgcgatgatctgtttattacgacaaaggtgtggaatcgtgatcaaggctatgaatcaacacttgaagcctttgaaacaagtatgaacaagcttgggctagatgtattagacctttatttaattcattggccagttgaaggcaaatataaagaaacttggaaagcactagagaagctgtataaggatggacgcgttcgagccatcggtgtgtgtaacttccatcagcaccatctagatgatctattagaagaagcagaagttgtgccaatggtcaatcaaatcgagctgcatccaaaactgacgcaggagcctttacgagactactgcaaggagaaagggattcatgtagaagcatggtcaccattaggcagcgggaagcttctgaaccatcctgttcttcaggatattgcgaaaaaacatgacaaatccgtggctcaagtcattcttcgctgggacttacagcatggcattatcaccattccaaaatctgtgacgaagagccgaatcatcgaaaacacacaagtcttcgatttcgaactgtccgcacatgagatgggagtcatcgatcagcttaatgaggatgagcgcacaggtccagatccagataattttgatttttaatcgaaagaaaagcacaggtggcatgcctgtgcttttttatttaacgattttttgcggctgatacgttttcaatgacttgaatggcgtcgacaatttgctctatggaatagtctccaatcaagcaaaaggtttcgtctgaacgtgcagcatggcttgccactgtttttgcggcttcttccagctgagctgtgatgccaagctcacgcatatttctaggtaatccgagtgtttcataaagctcaagtaattcttctacttcgctcattcgattttctgcggcaagctgaacaagaatgccataggccactttttgaccatgtaacacgtgatgcgtttcttcaataaatgtcaatccgttatggatggcgtgggctcctgccattctgccgtagcgtcccccgtacccgccgaccgtgccggctaatgtaataatggtatccgttacatctgcaaatgcttgcgaaagctgacccgtttgcaagctgtggacagcttcttcactatgggaaacaagaatatctctcacatataccgcctgttttagcgctgcatgcaccatgagcggcaaggaattctttgcatttcgaataatggcttccgcttcataccatttggccagcgtgtctccaatcccactttgaaggtaggaaagaggagaagaaagcaaaaatgtatgatcaatgagggtgaggtagctggaccgtttatggtaatcgactgtcatgaaattccctttgtcatcataaatgacgctaagcggtgtagatgcagcacatgtccccgggatggttggaaccatgatcacttcaatttgaagagcctctgctactgacttggcggtgtctaaaatcgtgccgcctccgatcccaatgatcacatctgccccttgcagttcttctgcaattcgagtaattgcattgggtgaactgtatcctttgtgctggacaacaggccaatgagacggaagctttgtgtactgtgaaaaagcatgaaatgaatcatatcccgtcacgacagcgggcgactggaaggatggagaaacaagtgaatcgagttcatgataaatgcctttttgagaaataaattggtttggaccgcttctgacgatatcttctggctggatcattgcgttctactcctttacaacatcatatttcataaatcatctcattttacagaaagttctgtcaaatatgagaagaaagtcccttccgttttatggaattgagccgctgtcattgcctttaggtatgtatttcctgtatgataaagaacggtatgttttgattaaatttaagaggtgtttatatatatggaaaaacaatatcgcgttttactttactatcaatatgtccccatcgaggacccagaaacgtttacaacagagcatctagcattctgtaaggagcttggtttgttaggtcgtatccttatctcagcagaaggcataaacggaacggtttctggtaccattgagcaaacggacaagtacatgcaagcattaaaagaagatccgcgctttgcgtctatgccgatcaaaattgacgaagcagacggtcatgcgtttaaaaaaatgcacgtccgccatcggaatgaactagtgaatctgagccttgaagatgatgtgaacccgttagaattaacaggtaagcatcttagccctgttgaattttacgagcaaatgcaatcacctgataccgttgtgattgatgcacgtaatgattacgagtttgatgttggccactttagaggggcagttcgtcctgatattgagacattccgcgaattaccggaatggattcgtgacaataaagagattcttgaaggaaaaaaaatcctgacgtattgcactggcggcgtacgctgtgagaaattttcaggctggttaaagcgtgaaggctttgaagatgtctctcagcttgacggcggaatagtcacgtacggaaaagatccagaagttcaaggaaagctttgggatggtcaatgctacgtgtttgatactcgcttaacagtgcctgtgaatcaaacagagcatgtggttgtcggaaaagatttcttcactggtgagccttgcgagcgttatgtgaactgtgcgaaccctgcatgtaaccgcaaaatgattgcaacagaagaaagcgagcataaatatatgcgcagttgcagccatgaatgtcgtacgagtgaacgtaacctatatgtgaaacagcacaacctgtctgaagaagaagtgcaagaaagattagctgtgattgaacaagaacaagcaatctcacaaggatagagggtaccccctttatccttttttctgtacagaagaaagagggattcatttcctctttctttttttgttttgtttttttcaaaataagggtaaaggtagttattcagtctaatagattgaatcatcgaaaaagcgctttcttgagaaataagcatgttcgactatttcagaaaatggagaattgagagataataaaacaggcgaaaaaatgaacaagggtaaagatttagttgaagaaatatttgtcaattgaatgaaaagtgagctgcaatgtaagaaaggtgcttacttgggcacatgctttgtaatttaatcgaaaggtgttatgaacatgaatcatttgcatcgtagaatgggaactttcgctttaatgatggtaggtcttggctcaatcattggttcaggatggctattcggtgcttggcgtgctgctcaaattgccggacctgctgctattttatcctggttgattgggatggttgtgattttatttatcgctttgtcttatagtgaactcggatcgatgtttccagaggcaggcggaatggtgaaatatacgcaatattcacatggctcctttatcgggtttattgccgcttgggcaaactggatcgctattgtctccgtcattccggttgaggcggtggcttctgtccagtatatgagttcatggccttgggaatgggctaagtggacaagccatttggtcacaaaaggggtgttgacaacagaagggctcatggtcgccagtgtgcttcttgtgatttactttctgctcaattattggacagtagggttattttcaaaagcaaatacattcattaccgtgtttaaaattgtcattccaggattaaccattggcgcgctcttattcgtaggttttcatagtgagaattttacgtctggaacaagtattgctcctaacggctgggcgagtgtgctgacagctgttgcgacatcaggaattgtgtttgccttcaatggcttccaaagcccgattaatatggcgggggaggcgaaaaatccagggcgatcaattccgattgcgattgttggatccattttgattgcgactgtgatttatgtgtttttacaaatcgcttttatcggtgctgtcgatccgtccatgattgtgaatggatggggtcatttgaattttaactcaccatttgctgatcttgccattgcacttgggattaactggctggttctgattttatatgcagatgcgtttgtatcaccttctggtacaggaattacgtatacggcgacgacgtctcgcatgatttatggaatggaaaaaaacaaatacatgccaagtgtacttggtcgtctgcaccctatttatggcgtgcctcgtccagcgatgttttttaacttagccgtctcgtttatctttctgtttttatttagaggctggggtgtacttgcggaaatcatttctgttgcgacacttatttcttacctgacaggcccagtaacggtcatgacactgagaaagacagggacagatttatatcgtccccttcgaataaaaggactcagcatcattgcccctctcggttttgtctttgcgtcattgacgctgtattgggcgagatggccgttaacaggtcaggtgctattcattatcctcattggtcttccgatctatttttactatcaagcaaaagcgaagtggaaaggcttcggccgcaacttcaaggcgggtgcttggatggtcgtgtacttacttgtgatgatgacgatttcctgccttggcagtgacaaattcggcggttataacgtcattcattatggctgggatatggctcttattacagtggtttctttgctgttttatatgtgggcactcaaaagtggatttgaaacagaatttctagaggatgcgaaaaaaatcaatgatgagctgcgtacttcttcgcaagaagccgcatcttccaaagaataaaggaacggctgcctgaatatgacgggcagccattttattttgataaatgatgcatcacatgctgcctcagccaagtggtgacaccgcgtaaaacggctgctgtgacaaatgagatgagtacatacttcccaagctgattcataccttgtccactaagccaaaacacgattcctagaaaaacgagtgtgaatagaagcatgaaaagaaatgatgcagaccaaaaaaaagccttcactgaaggtcacctcctcggagtattgtatgcaggcaattgaaggatcagaccagctatgacggggtagaatgatggtgaaatctattgcaaaagtcagataaaaacaccaagtgatttgacagttatgttaagatgagagcatattttgagtgaagattgtggtttatagacggaggtgtttggggttgcagatacaaaaagttctaaacaataatgtcattagtgtgatagatgaacaaggaaaagaaattgtcgtcatggggagaggcattgcgttccagcggcggtccggggacccggttgacgaatcgttaatcgataaagtcttccgcctggaggatcactccgttcatgagcggatgaaaatgctgcttctggaggttccgtatgatgtggtcaaggtgaccgaagaaatgattcaatatgcacatacaaaactgaaccgaagattaaacgaaagtctgcatgtatcactcgcagaccatattcattacgccatcgaacgattgaagaaaaatcatctcattgagaattcgctcatttgggagattaaacggttatacaaagatgaatttcttgtggcaaaggactgccttgatatgattgaagagcgtcttcatattgaattgcctgaggatgaagcaggctttattgccatgcatatcattaatgcagagctcaatgaggacatgaatacaacggtcaatatcacaaaagaagtaaacgccattctcaccattgtgaaatatcatctcaatatggaatttgatgaagactcactcaacttttatcgttttctcacgcatttacgctttttcgtccagcgtctgattaacgaaacaatgcttgtcagtgaagatcaggacttgtatcagctgatcaaggtaaaatatccgaaggcatacgaatgtgcaaaaaaaatcgcagaatatgtctatcaaacctatcaccgagatcttacatcagaggagatgctgtacctatccattcatttgaatcgattgatcaaacgagaaaaataaaggtagtttttaaaagaaagcgttgacataataaaagctgagtggtactatttgctcataaacataaaagaatacggtttcacaatgatcgtcttagaggattgtgactgttcggcaggcaaaacctaaacgttcactgaaaaagcgcaacagcaagttgtgactatttttggtgcccgtttaggtttttattttgcccaaaaacgtatttttttgaaaaaaagggggtttttgtatgagttatcgtcaattagcagaagacattatcaaacacattggcacagagaaaaacgttcattcactggtccattgcgctacaagacttcgcttcacattaaatgaccgatcaaaagcagacaaagcagccattgaaaaattaaatggcgttgtgaccgttatggaaagcggcggtcaatttcaagtagtcattggtaatactgtaccagaggtttatcgagagattggggagtttacaaatctattagaggattccacttcttcatctgcaaaatcaggtggagagagcacgagccttttcggaaaatttgtcgacattgtctctggtatttttacaccacttctcggtgtcatggcaggtgctggtattttaaaaggtctattaggtatctgtatcaatgcgaaatggttatcacctgaagatacgtcgtatcaaattttatttgctgcgtctgacagcttgttctacttcctgccattactgcttgcattcacttcggcgaggaagtttaaagcgaatccatttgtcgctgtgacgattgctggtgcactcatttacccaaccattcaagaattgtcaaaaggcggcggagatgtgaccttcttcggtattccagtcgtcttaatgtcttatacatcaacggttattccaatcattttggcagtgtttgtcatgggatatatcgaacgtttctttaacaaagtcattcatgaaagtgtcaaaaactttattactccactgattttacttgtcacggttgttccgctgacactcattgtattcggaccatttggtgtgtatgcaggggacggcattgccgctgtcttgctgaaagtattctcctttagtcctacacttgcaggtgctttaattgcgatggcatggcaggttcttgtgatcttcggtatccactggggtctagtgccagtcattttaaataatattgctgtccatggaaaagatcatatcaagccggcgactgcgccagctgtattttcacaagccggtgcttccatcggtgttatgctgaaaacaaagaataaaaagctgaaatcattggctggatcgacagcagtttctgccgtgtttgggatcacagagccagctgtatacggggtcacacttcgtttgaaaaaaccatttattgcagccgttatctctgccggagtcggcggtgcgatcatcggttattcacaaagtattgcgattgcgtcaggacttccaagtttactgacacttccgattttctacggacaagggtttacagggttcatcatcggaatctcggtctcgtttgttctatccatcgtcttgacttatttgattggatttaaggatccagtagatgaagatgaaacgccagcaccggctgcggcaccaacaatggaaaacgaacatggggtcaaagcagctcatgtgaaaagtcctttaaagggtgaggtaatcaagctggaggaagtacaggataaggcattctcatctggtgcactaggaaagggcgcagccatcattccatcagaaggtaagctgtttgcaccagtatcaggagtcgtgacaacggtgttcccaacaggccatgcgtacggtcttacttctgaaagcggagcagaagtgctcattcacattggactcgataccgtacaattaggcggtcagcattttaccccgaaggtcgtacaggggcaagccatcactgagggcgaattgcttgcggagtttgatattgaagccatccaagcttccggcctgtccgtcacaacaccagtgattattaccaattcaggtgagtttagcgatatcatagaaacagaagaaaaacaaaccacaccaggacaatcatttttacatctcgtttaatgaagaggaggaagaaattatgagatattcaacactagcaccatttccaaaggactttttctggggcggatctacttccgcctatcaagtagaaggtgcgtggaacgaggatggcaaaggaccatctgtcattgatatgagagcaagttaccctgaagggacaacagattttaaagtggcaagcgatcactatcaccgctataaagaggatgtgaagatgtttgcagaaatgggtttgaaggcttatcgtttctctattgcatggacacggatcattccaaatggagatggggagatcaatcaaaaggggattgaattctatcattctctcatagatgaattgcgccgctatgatattgaaccaatcgtgacgatgtatcattttgatctgcctcatgcacttcaagtaaaaggcggttggtcaaatcgcgcgacagtagatgcgtttgaacggtatgcagaggttctatttcaggagtatggtcagaaggtgaaatattggctgaccattaatgaacaaaacatgatgatcttacatggatcagcgctcggtacacttgatccaaatttagaaaatccgaaaaaagaactgtatcagcaaaaccatcatatgctcgtcgctcaggcaaaagccatgacgctttgtcatcaaatgctgcctgaagcgaaaattggaccagcgccaaacattgcgctcatttatccggcttctccaaagcctgaggatgtacttgctgcggcgaattacaatgcgatccgcaactggctgtatcttgatatggctgtctacggccgttataacaaccttgcttgggcgtacatgaaagaaaaagacattcttcctgtcatcgaagagggagatatggatattttgaaaagtgcgaagccagacttcattgcctttaactactatacatctcaaacggttgaagcgagtaaaggagatggcaacgatgaatttgctcgcggaggagatcagcatttgaaatctggtgaagatggcgtatacaaaggcggcaataacccgttcttaagtaaaaatgcgtttggctgggagattgaccctgtcggcttccgatcaacgatgcgtgagatttatgaccgttatcagctgccccttattatcacggaaaacggattgggtgctttcgacaaattagaagaagatggatcgattcaagatgattatcgaattgactatttagaaaagcatatcgaacaaatcaaatgggcaatcacagacggtgttgaggtattcgggtactgcccgtggtcagccatcgacttaatcagtacacaccaaggctgctcaaaacgttacggttttatctacgtcaaccgtgatgaatttgacctgaaagacctgaagagaattcggaaaaagagctcttattggtatgaaacattgatcgagcaaaatggggagaacatcgggaagtaacaggaaaaagccagtcaccttattagcgggtggctggcttttttgttcgttcactttatcggcttgtgtcatttgtctaccacagaaattttcagcaaaatgaagttctaaaaaataaaaaaatgattgcggacaccgcagtcaaaaaagaaattatcttaaatccattgatacactcattttgatttgataacctttattttggaatttaatacaaaaggaggaatataaacaatatgttcaaaaaaacacttttaaccctaattaccctagctcttgtcatatcaatatggactccattttcatcagaagcatcagcagaaacacactctatcaattcacaagaattagaagcgttagtaacaccaacagttctacaaaatgaacaagctaccaaagaattagatgaacttgaaatgaaaatgggggaatacatagaaaatcttccatttacagaaaaagaattcgaaagcatgtcagagtcagaacaaaataaagtgatcgatcaatatttcaacaatgaagaatttttagctttagaaaaccgaatgaaacaacttgactccaaaagtagtcagagtgaaattacaacacaagcactaccagtattcttcatacctatcgcaatgaccgtaggaagagttgctttaatggctatcagatcaaaaggcgcaagaactgcacttaaatatctaaaaaatcggataaaaggatttggtaaaaattacaaaattaaatgggatgtaagaaatgataaaggacaacttagaagtttagttgtcgtcctacacaaaggaaagaaaagaacaacaagagtatttgctgtagacaatggaaaaatccctttaataccaaaaacctcaacttggtattggcatttccatgtagctccaaaagataaaatacaccatgctctcagagcatcagtaccaaagaaatacaaagcaagtccaggagaaacaatattacactaaaaaacccctaatttttaggggtttttttctcttcatgacttgtaactatatcaacaggatgtatcaagttttcatcatcattatcctcatcaatgtaaggcataataagtgaatccaactcttctttatcatcaactaaagcaacgtaagttgtataatcctctaaatctgatggaaacaattcagcttgaccaatattacttttcaatgcttggtcaatagcactctttaattctattaaaccctcacgattaccaataatataagaatccatgtgccaacttttttgagcatatatatgacaaatcttatctctatctttcatcatctcattacacccttcctgaaaaatttaattgattatgtgccaacacgcaaccagctataacatcaaacgtctcattggctactttatcctcattttcttcaatcctgataagatatccttcctagcatcaataaactatttccaaaactgtcaccaacatttttttgcccttttttccttctgctccgttgtcgcaattaattttttagtttcttgtttctcttatggcttctaatagctttttatctcttttaataagactgctttgtatgtattcttgctgttttttaactttctggaggttacaaatcccatcttactctctactatcattataccccgaattcaatctcatttatagactgttttccgcccagatcaggccgtatactgttatacgcaagtcaaaaacgataagggatgtggctgtatgaacgagaagcaacaagttttagatcttggcccattttttcatgggacgaaagcagaattgaagattggagatctgcttgaaccgcagtacttatcgaattatcaggatcaaaaatcaaaccatatctatttcaccggaacattaaacgcagccaaatggggtgctgaattagcaaggtctgatgcgaaagagagaatttatcttgtagaaccgttaggcgagtttgaacatgatccgaatttgactgacaaaaaatttccgggtaacccaacacgttcttatcggtcgaaatccccgttgaaaatcgtcgcagaattaggttcatgggaaagacattccgatgaagaaatcgatcatatgctgagctctttaaagaaattaagtgaagaaggaaaaaatgtcatatacgattgatgattctcaatcaacaaaggccgccttatcaacagctgggcggccttttgtttgatcttattgaaacaacgcatccatcagctcatcaaatgattttgattgattcagggagtgaatgcggtttggattgtccagtaaatcgacggcctgttcaaagaattgattcatgcaggctgcgtcatctttatgaatggctaataaaaagacaagtgatacttggtttccctgccagtcaattggctgttttaagtgtgcgatggctacgcaggatgtgccttcatttgtgatgagcgggtgcggcatggcaattccttttccaagataggtagacgacatttgctcccgctcaagcaccgaggaccgaaaagatgacgatactagctgatacgtttctaaacggctgcatagggtgtctaatacctcgtccttactggatagatcagcattcattaaggtcaatcgttcttgaaaaaacgccatcagttctttcggcggagtcctgtgtccatttaataaatgaataacctcattcacccgctgtacatcatgatgttcaaaaaaggcgctgacctgtatgactggttttccctttgaagcgagcgggacggttgtaatgatgacatcacagggcagggtggtgctcatgagataatcttggtaggaatacagctcgacgatgtccagttcgtgctgaaaggatgccttcaatttaatttcaagcagtcttgccgtccctaatccagacccgcacacgataatggctttctttttttgcgaggtattaagctgacttctttcaaatgaagcagcgatatgcagggcaacatatgccgcctcatcttcatttggcgttcgcaccagctgtaaggcattcagcccgctgacagccaaatcaaacgggtatggataggacgctttgatttcatgcagcagcggattttgtaaggatacgccatattggattcgatttaataatggcttcatatgaagcatcaggtcttgctgcaggatgttgtcatctgcaaatcgatgtccgctcattttctcaatgtgctgtagaaagacggtaaccgcctgctgaacttctactgtcgtctgatgctgggcggtttctttccacgtttgatttgccaatagatgcatgactaagtaatctgtttcatcctctgataaggtgacgtaaaaggtgtcactcacctgctgtataatttttttggcaattcgcattaagtcgggtgatcgttgtgtacgagtggtattcgccgatattcgctggttttttcgtgtctgctgaatcgcaatcgctaagtgaatgactaagttttttaaggcaatgtctttaatgagcaatgactcttgatgcagattcgtcaggacaatcgatcgaatggtttcaagagaaatatcgggaaaatggagctgctcccgctcggtgatatgagaaagtgcaggctcttcttcaaggagtaagtctgcatagcatgttcttttttgcaactcgtctccttcaatttttaagccaaacccaggctttgacacaagggtcataccgtaacgggctaacagctctcgccctttttttaaatcactgctgaccgtcatgcggctgataaacagttcttcagccagctggtcaatttttaagtaatccgcttgaagcaatagcttcctcatgataaatcgtacacgctcttctggcatgacggggacgagagagtgggcaggaagtttctgctgatgaagccagagcaggaaggcatcttggtcactcgttaatagggtgtatccctttccgcggatcgttttaatcttggctccagcttcctttaattgctcatttgcttctttgattaaatgacggatggagcggtctgataagtgaaaagaggcagtgagctcctccagcttcacgaaccccttcgtttcaaatagccgctgaatcagctgataggttcgaggatctgccgtcatcatcattgcgcagctccttgcgcctgtaaggcatcagtaccaagagcgatggcgcccattaaacctgataatccatcaaaggatggcttggtgataatttcatgtaaaggctttggcagctgtaaatacccatgaagccgcttttctgtttcctcaagaatgaggggcagcatagcgggctgtttcataacacctccaccgagaatgatgcgttctggcgaaagggtgagtaataaattggcggtcatctgcccgagatagtaggcatgaagtgaccaggcaggatgatcctctggcagcatgggtgccagtgtatgatagcgcccttctatggcaggtccggatgccagtccctctaaacaatcatgatgtatagggcagcatccaccgtaggaatcatgggggtgccgctgcactgtgatatgacccatttctggatgcagcaacccgtgaatgaggtggtgttcaatataggcaccgccgcctatcccagttccaacagtgatatagaccaaagaagcaggtttttctgcttcaaccgaaaagcgggcttccccgagtgctgcacagttcacatcggtatcaagcttcatcgggagcccaagggcttgttttaaggtagagaggaaagggaattggcgccaagctgttttgggtgtctctaaaatcgtcccataacttgggctgtgctcttttacatcgacaggcccgaatgccccaatgccaatggcatcgacaggatgctttgtaaagtaatcgatcacttgccggcatgtttcaattgggtttcctgttgcaaaggaagtcatgtgttcaatcgttccgtctgttgttccgtagccgcagacaaattttgttccgcctgcttcaatgcctccaattcgcatgatcaatgccctccgttaaagaggggcggaatccaaatggaccccgcccctacatgttcattttttctttacaatgtaggtttgtacctgacaaggtgtgagcggttcaatgtgtaatgatccatgttgtgctttgagtacatgtccttcaggtgtttcgcctaaattcgctgtttctccgtgttgtagagatgaactattgattgaagcggctgtttgacgcgttaaatatggattgaagagacggatgacaatgccagtcccatgctcttcttttttcagagcgcttagaatggctccgtctgtctcaatgtcaagcaggctataagtagattgtaagtcttctttttcatctcggaaagagaaaattaaacgaccgtttaaaaagtctgcccgttcgtagcattgaactggggtggtataccgcttggcaagctgcgctaagtgcccctcgctgacagcatccttgctatagtgcatgccaaatgaaaacgacagtgccccttgcagctgagcgtcaggtgtctcaacaattttttcgccagatgcgcgtcctggacggtaaagaagattttctttccccatttttccgaaacagcggaagagcgtatacgcgattgttgtgtagtcttctcctgtgatctggtattctctcacgcagtccgtcaacagcgcgacaccgtatgcttcatcacgaagtgcagtaaaggattgcatcggttcaatggtgatcggtttttcttcccaatgttcattgctccaccattcaagctcttgcgtgagctcagttgggcgttcgatggttccaaactgctgatcgctcaatgatacttttgatgcgatacctgtatcaaagaggacacgcagacgatggtctaacgcatgattgtcgacatcgacatgaaaacggatgacaggctcatctttgtttaatgccaccttcgctgtaatcgggagtgaagtcgtgactgcttgctgagagcgctcttctaagtcatatggaaccgtgagagtaagctggatggtgagctcttcttgcaagccgcttttagacactgtgatgtctgctgaagaaagatccttggatgacacatacagatcctcgcgcggcggggaatagttgtaggaatccccatcgtctccattgtcttcaaagatcatttgctcagagaatgtctggccagtttgtttatctgtgatgtccagcgatccattgttgtttgccgtaatgcggtaatacgtattttcaaccgcatgtccttcggtttgttcccatgcggattcgctcgattcaccgaaaaccatgctgacttgtgtataaccaacggatggtaagctggcggcttcgatcagtaaaacggctttccatacctgctttggcatgtacacttctttacttgggttaagagaaatttgctgtgccagcacataatctgtgacagcggttttgcttttcactgtgtactgaagtgttctcccatgtgcatcctttagtgtaaatggacgttcggtgataaaggtttcgacttcaatgacttcagaacgttttgaaggcaatgtattaaataacgtgagtgtgatgtcttgctccgtttgcagtcgaatcgcaatgagacgcatgtgcaggtccacaaggttctcggcgatttcctttgcctgcttgtagcggaagaagacgtcttgattcgtcgtatcactattacatccgccgatgctgtcatgcgctgcattttcaaacatgagataccaaatatcacgaaccgtgtcatgcggatagtcgtgcccgagtgaatagctgatcgtgaggataggctccattacattgacgagatagttttcaatttgattgtttaagatttttaaatcagcccgtgttgaaaaaatagatttgtgaatccgcatatgctttgcatggatgagctcaccttctaatgtttcaaaagatgtccgttcttttttcacagctgcgatgtaatcttctaaactgctgatttgatagtggtgctcgtcaagatcattggctttttctaataagtcaggcaggtttttgcggattggtgcctggtcaaagccatttgggaaatagacattctttgtggtggcctttgcttgcagcgcaccgattttttcagataaaaaggcttgtaagtcctcatccttttcaggaatatttccaccgtagtagtagccaaatggcaggttcaccgcaaagacttcactgccgtcagcaccttgccaattgaattcggtgtgattcgtcatatgatctgaaacgccgcgccaaaaagccgtatcgacaatgccaaatccgcggtaaatttgaggcatttgcgcggattgaccgaaggaatcaggaacatagccgactttcatcacatgaccgaactgctgacagcgttcaattccatattgcaggttccgtacaatggattcacctgaaatgacgagctgatcggtttgggtataccatggaccgatgatgagacgtttggctgtgacgagctttttgattcgattctcatcctcagggcgccatttcaagtaatcatccaataaggatgcttgggcatcgagcatgaaataatggaacctttcatctgtttcaagggtgtctaaaatgtccattacgcttttcattaagtagatacgggagcgggaggtggtgaaataccattcccggtcccagtgagtatgtggaatcacatgtacattgacagtcattgatcaacgacacctttctatgtgcaaattatccttctagtacaaggtcaaaatcgtcttcttctttctgcttctgatcatgctccggcgtttttggttcttttttctcagagaaattgacaagcaggttggcaccaataccgatgacgagtgcgccagtgagggctccgattaaataggcccaccagtttccgactgagaagaagccgtatagcccgccaattggcggcatgatgtcatgaacacctaataatgcagcaaccccgcttccagcagcacatgcgacaacattgagcggaatcaattttaatggattgacaagggtaaaaggaatcgccccttctgtaataccgataacgcccatgacaagaccgccacgtccagcttctctaaaggttggagagaagttgcgttttcgaatcagtgtcgcaagcccgtatccaagcggcggaatgacaatcgcaatattgacgagaatggcaggaaggtagacgcctgataggaagagcgcgttaccggccatccaagcagatttattcactggtcctccaaggtcaaagccaatcatcgcacctaaaatcagagcgagtgcgagtgtgcttgtcccgtcagcgaccatacctttgatccattcaattaaagccgtgttcaaagcgcctaatggcccgcccagcagaacggacatgagaagtccagttaagccaacggtaataagcggtaagatgagcagaggaacaagtccggctgcggagccttgaatttgaatttttcgttttacaaaaagagcgacatatcctgcgaagaagcctgcaataacggcaccgataaatccagcattcgttgagctggcaagggcaccgccgatgaagccggctgcaagccctgatttatccgcaatcgaataggcgataaatccagcgagcagaacgttcattaagccaatacctgtccagccaacctgctccattaaataggcgccgtgcagtatgccgccagcatctttataggcgtttaaatctgaaacaccaaaccctaatccgactagttttgctaaacccacgataagggaggcgccgatgatgacaggaagaatataagaaataccggtcatgagatggccttcaatgacttttaattttgctttcattttgctttgctcctttctatatggcattgctcacgtttattgagattcagattttttcttttcaacaagtgctacagcttttgtgatgatttgctcggcattttttaaggcgcgtccaatctcgacacgtactgtgggaatgcctgagaaacgttccgcatcgttgatatgctgattggaggcaatgatgcagaggtctgcctgctttgcttcctctgctgtaatgccatttacctgtcccataatcccttgctgctcgattttaatctcgtgaccgagctgtttacccgcattctctagcgcctttgctgccattggtgtatgagctaaccctgctggacatgaagtgacaccgacaattttcattgtgtaatcccctctttcaattgttgttcaatgacttcgtaataatagtcagcggcttgacctggttgtatcttttcgatgaaagccggttccatgaggcttgtcgcaatccctgacagtaatttcaggtgtgtgacatttgcttcttctaatggaacgagcagtgtaaataaatagcttgtgggcaaatcgtcaaagctgccccattcaatcggttgtgctagctctaaaaaaagaagtgaagccgattgtacagtggagctttttgtatgaggaatagcgaagccttgctgaagtcctgttgagacttcgtcttcgcgagtcaacaaatctgataatagccccgcctgatcgtttgtaatctgaaggtcttcagctttctcggcaatgtattgtaaaatctcattctttgatcgtccgtttacttgtgtgaaaacatgatctttttggaacaagctgatcccttctctcttgtttgttaagcgcttacaagttgattgtaatgtacttttcggcatggttaaatagcatcattttccgtttgaaatggcaaaaagtttatgaagctattcgtcttgcagtctgttatctcaaatcctagcttaaaacgagtttaattatgtaaaaaacagattctactaaatgcatttctgtgatattcttccaaggtgttacaaaagataagggggtcttttcatgttcaaaaagcaggtcaaatcctgtgtaatcgtactcatggccatcattctctgtatggcagcattacctggatacgaggcagcagctgccagtaaaggaacaaatgtcaatgaagccattgggttaaaaaatggtgaagtcatctcagggacattacagaatgaaatggaagagtcatggtaccaaatcacgccatctgcacaagaggtggcaaaagatacacatatgaaagttactgtcaaaagtaaacaagtgttatctgtatcggtctatccaagtaaagacagagcgatgaaggatgacacttattcgagatatcgtgtggacactgcaagtggagagacagagatcgacttcccgcatgcatgggcaggtccttattatgttaaagtgctctacttagggtcggaggaagacagccgtgatgaggaagaggatgcagcatatacaatcgggtataaaggagctaatctaccgccttctgaacccgttttccctgaagacgatgagcctgacatcattattatagagaaaaagtacgggcgcgaaattcttcagtcgattcgtacaattgaagataaacgttttaatgaaacaccaaatggtcagaagctgagccgtgtgcttcaaaaaacaaagccatttctcaaatcaaagctcatcaaacaaaaaaatgagcagcaaaaggtatacaatcatttgctgacattaaagtcactgctaaatgacgtagagaaaaatggtgcatatagcggtcatattgtgacagagaaagaacaacaggcgatccgttccctttttgatatgctcaaaggagcaagtcctgcctatttaaaaaaggaattagaagcagtgagtcaacagattggcatcaatcagcttgaaggaaagtcgatcggttatgtattagaaaagcaaaagcttgtaaaagaagagaaagtgaagacgaataaaatcatttttaaactaaaggatgggcaaacgcttcaatctgcgaaaaagaagatgaaaagctatggaatccaagaaaaacgtgtgacatcgcagtcagtaagtcctttgtttaaaggaatgtatgtctatgatgtgccagcagggcaagaatcagctggaaagactttaaaagcaggcaaagctgtgattaaaagcactgcgagaaagctgtccagcatgccgaatgttgaattcgcagagcctgttcaaacgtatcgtgcactgagcaatgatgtgcagtatggataccagtggccactgaaaaacagtgcgcaaaacagcgggaaaaaaggcgctgatgtgaagtttgaacaaatgaacacactgattggcacaagcaaaatgaagcaaacattgattgctgttgtggatacaggtgtagacagtcgtttaacggatctgagcgggactgttcgtacggacttaggtgcgaatctcattggacgaaacaaagatgccattgatgacaatggacacggtacgcatgtggctggcatcattgctgcaaaggccgataatcattactcgatggcaggtctcaaccaacatacgggcatcattccggtgaaggtgctggatgcctatggttttggagatacagagcatattgcacttggaatcaagcatgcagtggataaaggtgcaaaggtcatcaacatgagccttggcggctactacagccgcgtgattgaatatgcaatgaactacgcagctcaaagaaatgtactagtggtcgtggcgagtggaaatgatggcgttccagaaatgggttatcctgcgacatcaaagtacgcaatggctattggtgcaagcaaccgtatggatattgccgctgaattctcaagctatggtaaaggactgagcatgtctgcaccaggatctgatattccaagcttaatgccagatgggaatgtctcatatctgagcgggacatcaatggcgacaccatatgtggcagcagcagcaggattactgctttctaaaaatccagccttgaagccgaatcaagtaaggaatatcttgcaaagcacagccgataatatctcctttacatctgttgatggaacagatgacgttttctatgatgaaaatgaagagcctattgtcgatccaaaaattccagggatcgattggatgacaggacatggtagactgaatgcatttgctgctttaagtgctgtcgaactaaatgcatctgtcagcaaagtggaggatcagcatcaaaaggtgacaggtaaggcaaaggctggcgctgctatttctgtgtatagaggcaaaacactgcttggaaaaggcacagcgggcaaaaatggaacctttagcgtgaagatcaagcatcagaacaaaaacaaagtccttcacattaagatttcaaagggaaaggccgcaacgacgctcaaaacagtcgtcaaaaaaggcaaagcaccagctaagccgaaagtgggcaaagtaacggtcaaaagtaaaaagatcaaagggactgcgggcgcaggattgaccattaaagtaaaaaacaaatcaaagaaagtcatcaaaacggtaaaaacaaataacaagggcgcatttactgcccaaataaaaccgcaaaaagccaaaacagtcttgtatgtgaccgcttcagatgtgagaaaaagagaaagcaaagcggtgaaggttgttgttgtgaaaaagtaagaggagagcttccctttctaaaaaaagggaagtttttttgtttgttactggaaaaataccaattaatgtcgatagtgatatagtaggaaaaaaaaggaggatttatcgatgaaaaaaattatgtttgctttctttctatcattgcttctcgtattcccaacatttgcacatgctgaggaaaaaggagcagtaccagcatccgtacaagtaacaagtgttacagcagccgatagtggattagtgaattacggctatggcagtaaatatcgcgtgggctcttattatccagctacgtttaaaggaacactaaaagatacaagtggaaatcttatgcccaatcagccgatccagctttattttgaagcagcaattaaatcatatgctcaaacagcgacaggcacaacagacgagaatggacaattttcactgacgtttcaagttcctgcaggtgcaggctaccaaacatacaataatgcaggctggtctacacattactacgatatcgttccagtgacgttcacttcaaaagacatcaagctatcttcaaatgtcacaagtgtgtaccatttggcatatacagtacgtaactaatctgctgagggagacgacctggctgaagccttgtcgtttttttcatagaaaaaaggatgtcatcatgtgacatccttttctttttgttagcaaacctgctgggcggcaaccgaaagagtcgataaacaaacactcatgagccgtgactcccagattcgaacgagcgtttaacttttaattctgagctttgatggataagaactttcacacttgaacgttgatccttgaaccttcagctttgagcttttatcaaggatcatccagagatgatcagatgaggagggaatgacctttcccacggaggtgtttagttctatcgattttcggctcactaacaaaattgattaatcgatctgtattttcgttagtgtattgctctctgacaaggaaaaatcaacttccatttgaaaatcctcaatgtgggtcgaaagcttttcaatcttcactcgaagatgaagcggatcgatgattgtcgcctcattttcagcgaggaacgacttgacgatctcttggttggcagccgcttgtgtttttccgtctttcccaaacaaggtttctaaatgctggtcgagcctcttctttacctcttcattggtctgttctgctttgtctactagctctgtgtatacctttttcaatttccgtaaataacgaatatcatattctatcgatgtcttccgttcaatcgcttctgccactgtcatgctgacacccgctacatcaatcgttgttgtcgcattcgaaacaacgatggctgatttaatggcattccggcgtttgattaatgcttgaatcgattggtcatcagccttcgctttcttttcgatttcttcttgatgttgaaacccgtgctgtatatgtttcccgatcatcaatccaccaagtacggcttcatcaatggttcggttgattctcttatctaacattttcagttcgcttaatgctcttgtaatggtcatttccatattagtgacaactcccttggttcatcctgaaaatcatagaatcctatcatataccaaagtgtgcttcttttactagcaatatccttttttgtcagactgttatcatagaaaaaacctggcgttatacaccaggttcttcacgttttttctgaatccaagctgtcacataataggcagcatagcagagcgcgatgaagggaatgccgcagataagggcaatccgctgatttggatcaaaggcaatgccgatcacagaggcaagacacaggaagaaggcagcaatcggaaccactgggtagagaggggttcgaaaggtaagatcatggagctgtccgccttcctgtaaaaaacgtttccgaaacataaattgtgaggcagcaatccccatccacacgatcacaacggcaagtcctgagatcgaaacaaggacaaggtaaaccgtttctggtgcgatgacacttgataacaaagaaagaatcccgccgatcatacttaaaatcagtgcgttcaaagggattccttttgatgtcagcttcgccagtttcttaggcagtgtccgttcctcagaaagtgaccagagcatacgggatgacgcgtatagtccagagtttgcggcagataagatcgctgtcaaaatgacaaaattcatgaaatctgcggcatatggaatcccgatgcgatcaaacaccacaacaaatggacttttgatcaccccggcttcttccactgggatcaagccggctaagaccacgattgttccaacgaaaaacaagacaagccgcagtacggtagtgcgaatcgctcttggaatggtttcgtcaggattgacgctttcacccgcagcaatcccaattaactccgtacctgaaaaagcgaaattgacggccagcatcgtcattaaaatcggtaaaaagccgtttgggaaaagaccgccttccccggtgaagttagaaaggaacggagcggcctcaccgccctttaatggaatcaagccaaacatcgcagctccgccaaggataataaagagaataatagccattactttaatgctggaaaaccaaaactctgattctgcaaaaaacttaactgtaaacgcattgagtaaaaagatgagaagagcaaagacgccgctccacatccaaaccgatgtgtctgggaaccagcgctgcattaaaagccctgccgctgtaaattccgatccgagtgccactgtccatgtcagccagtacagccaagcaactgtgtagcctgtgccaggtccaatgtattttgttgcatacgtatgaaaggcccctgtaaccggcattgcgacagacagctcgcctaaacagagcatcacgaggtacacaattaatgccccgacaagataggcaaggatcgttcccgcgggtcctgcttgattgatggtatacccagagcttaaaaagagccctgttccaatgacgccgcctagagaaagcatgaacaggtggcggctcgtcatttttcgttgatattgttgtgattgatcttttgcttgttccatgtcttcccgcccttttgcttagaagtatgtgtgatgattcatgctgctatgatgtggtaagtcttaagatgtccgtgatatcttctggggtcgtccggcagcagccgccgatgatatgcgcgccgtcttgataccattgatgcgcacattcaccaaatgtatgctgaggcgtatctccgctccataccttttcttcgggatcatataactcccctgagtttggatacacgacaatcggcttgcttgtcccctttttcatctcttgaatgagagaagagataaattgcggcggcgtacagtttacaccaacagcagcgatctgttcataaggttctagtgcgtgtacacattctctgagcaaatcaccttcactgatatgaaggtcgtccctcgcactgaatgtaatccaagcagatacatcactgaattcatcttgcagcagctttgcaatggccgttgcttcaatgagacaagggatcgtttcacatgcaagaatatctgcaccagcttctactaatgcctgaatccttggtctatgaaaatcaatgagtgcctgctctgtaagcccgtaatttcctttatattctgaaccatcagataaataagcgccgaatggccccacagatcctgcaacaaatggttttgtccgccctttacgactggcttcatcctgccaaaaaaggtcccgtgcctcttttgctaaagtgacagatcgtttcattaggtcaatggcttcttcttttgaatagcctttttcagcgaagccatcaatcgtcgtttggtagctcgctgttgtggcacagtcagctccggcttggaagtaatccaaatgtacttgctgaatcaattctggctgttcaattagtattttggcggaccataaactgtcgtttaaattacagccctttcgttcaagctctgttgcaagtgcaccgtctaaaattaaaggtgcgtgagcctgtaagcggctttgaataggattcatggaatggaacaccctcctttttagtcggaaatgatggatatgatatgaggcagtagtttaaatgactaaagtgtttttgtcaaggagagggaaaagcatgtgatggctgaaaaaccctgaaaacatgcgggtttccatgcataaacatgcagtcaaaataatagaaaaccaagtcattgacagcctctaaaaagagatatatattatgaaaaggttcatatcagaaagcttcatcaaaaggcgctgtcttttgatttttattttgttcaacgactgtcttctttcgtgcagaaagagggttttttatatgcttaaaaaagggggaaagaagaaattgaaaaaatgtgtaaaagatatcgcaatgattctaattggttcgtttttatttgccgccgcagtgaacatgtttgtcattccgcttgaatttggtgaaggcggtgtaacggggctgtccattattttttattatttgtttgaaattgcaccatggctgacgaacctagtgtttaatgccatcctgctgcttgtggggtataaatatttagacaagaagacgacgatttatactgtggttgccgtcgcaagtaactccctattcttacacctgaccacaacatgggtcgtgaatgttcacgaattgatcattggcgccattttcgcaggaatcattatcggaattgggattggtcttgtgctaagagcaggcggtactacggcgggttctgccatactcggaagaattgccaacaagtatttagactggaacgtgagctacgccatcttgttctttgatctgatcgtcgtatttgcttcctactttattattggtgcggaaaaattaatgttcacgattgtgatgctgtacgtggcaacaaaggtgatggacttcgtgatagaaggacttaacacgaaaaaggcagtgacgatcatttcttcatgcaaagatgatattgccgaagaaatcaatcacaccttggatcgaggcgtgacgattttaaacggacgcggtcattattcaaaggaatcaaaggaaattctttatgcagtcattcaaaaacaagagcttatgcgtctaaagaaaatcattaagaaaattgatcgagacgcattcgttgttgtccatgacgtgcgtgatgtgttcggagaaggatttgtgaatatataaaaacggaaagaccccaaaagggtcttttttttattttatgctttatacctcttgtcacatgatactatgtaatgtatagtataaatggttaggagttgtaattatgaatgcacaattaaaaaagggtttacttgaattctgtgtactggcggtattaaagaaaggcgattcctatggttatcaaatgattaaagatatgtcccattgtattgagatttcagaatcgacattatatccgatattaaagcggttagagcaaaacaattatgtggagacctattcccaggaacataatagtcgattaagaaaatactaccggatgacacaaagcggccgtgagcatatggcgcagtttttagcggaatgggatcaagtgatggcgatttacgactttatttctggaggacagggcaatgaataaaaaagaatttttagctagcttagagaagcacctgcatcgtctaggcgaaaaagaaagtgatcggttcatcgagtattacgatgaaatgatcgaggattatcaggaagatggctacagtgaacaggaagcggtcgatcaagtcgggcagcctgccatcatcgctgaagggattttgaaggaacaaggaattaaaaccgttcaggtgccgacgtttggagaaaaagctacaaggctttccatcctcattttaggttttccattatggggtagtattctagccacagttttcctgctaattctttctatgtatatggtaatttggtgcattccactcgtgacaggtacaatgacgctagttggtctgctcggcggtttttggagcatcattggttctccgtttatctttcaggacggtttgcatgtggtggtgacgcagattggcgttggtatttttctattaggtgtcggattattatgcggcatggctacggtgtatttgacaaagctatttgttcaaatgacttttcaaaccactaaggcattcatgggaatgtttaaaaagaaggttgtgagagtatgaacgtgaatgatttaaaaaaacaatgcatcaaatgggggatcatctttaccgttgccggaggaattgtcatggcaattggtttaggactatcaggctttgacctagatgcatatgacaacaatgaccagaacaatgtgttccgcaccatcaattggagcaagccataaatgaaagacccgcttatgcgggtcttagcgtgtagacaaaccctcgcattcggtgtcagtcctgcgcgtcggtactcacgaatgtcaaattcgctccgttccggtgctcgtccttcctagactgcaaaggttttctatcacgctgaaaagaagacaaagggctaaaataaacatcattttagccctttgtcaacaatctgagacccgcttatgcgggtctttttttcgctcgaaccacaaagaagaaataacagcaaagtgcacctagttcacaaagcataatgatcaggcccattggaaaggctgtttggcttccggctagtccgacaagaggcgtcatgcaggcgcctagcagcatttgtgccacaccgatgagtgcggctgcacttcctgcatgtgcgccgtgatgctgcatcgcaagagacggggcagaggtgccgacaattccaacgcttgataccacaaaaaagagcggaatgagaataccatacaatcctgcatcaatggagatcatcaaaaataaggtgacgccgcctaaggcagctgtcagcaatccaatgcgaagaaccttctcttcgccgattctcgcagcgacacgggcaaatacttgtccagctgtgatgattccaagactattcaccgcaaaggcagcactgaatccttgtggagaaaggtgaaaaagctcctgaagcacaaacggtgagccagaaatataagcaaacatcgctgcgaatacaagaccttgcgagagggcatatcctacaaagagacgatcactcgctaaaattttcatggcgccaacaatctgttgaaagcctcctgtttgtctgcgctccgcaggtaaactttcctgaagtgaaaaaatagatctcagcagcatcaaagccccgagaattcctaatagaacaaatacaccctgccatgtggtaaagcgtaacatctgtccgcccacaataggtgccgctgccggagcaaccccgttgaccaacatgagcagtgcaaagaatttcgtcatttctgagccttcataatgatctcgcacaatggctcgtgcaatgacaatgcctgctgaaccagcgagtccttgaatcaatcttaagaggatgaacatccaaatcgacgagaccaccgtgcataaaagagaggcggcgataaaaatgattaagccgatcatcagcggttttcttctaccgatcgtatcactaataggccctgcaatcagttgtccaagtgccagtccaataagacaagccatcagacttaattgggacaaagcagtgcttgcttcaaaatctcgcgcaatatgaggcaatgcaggtaaatacatatccattgcaagcggtgcaagggcggttaaagaaccaagcaatgcggcaaggagaaatcggttttttttcgattcttggggataagataaagaactcatatgatcattacactcctcgtatacttcctcaaaacagcataatgaatcaagcgttctttttcaatggaaattttcaaagaggattgcgtgcaaaatgattgatctttcgaatgagactctttacattgaatgagtagagaaaaggacaaggtcaacgacatgcagtatttgcaagatacgtatatctagcattaaacaacaggaggtgctgacatggagcagcaagagctgatcattcgtcaagcagtcaaagaagatcatgaagcgatcagacatgtactaatcaaatcctattcacagtatgagcctcaatttacggaggaaggctggcaaaattattctgctgcgcttgcagcagctgtagataatccaaacatggagctgatgcttgtggcggagcttgaaggcaaggtcgtggggacgcttcaaatgttccggtcatcagagcaagcgtatgacaaacccgaaatgggcattacatcagccatcgtccggtttttaggagtagatcccgatgtcaggggaaaaggaattgcagagtcattgttacgtaaaagtattgaactcacgcaatcatggggcgaaaatgttctgtaccttcatacatctgataaaatgcaggctgccattcgtctttatgaaagaatgggctttgagcgtgcactagataaagaatttgtgaatcaaaatgggacgcatgtcaagagctatcaatatgtcatccagaaagaacagccggcaggttcatcacatcacgcgtaataaaaggaagagcatgtcctctatggacagctcttcctttttcaatttacgcccacagtataagcgcccaataggatactccccacgagattaagccgaacataacaaagaattttaacatgcgctcataaggagaaagctttcgttctctcttcgttttcaccagccgccaaaaatgaggatgatttgtccaagctgtgtaaggttttcaagaatcgtgattccgttcatttatttcacctcatcataggtcttccatatgtgaatgcagcaagcctttattttttcataaaaaaacggtgtatactggaaagagagaaactagatgcaagagggagttgtgacatgttgttttcgctacatgcggatcggtgggatgaagtaattgagagaaaaatcaaatacgatcagaaggttgtggaacatacgtgtcagctgttagatgcacagggacagaaaatggtgctttttcacaagattgaagagacgttttcgatgagtgcaggcgatgatacgctgacgattccaaaagggagctatacgaccgcctactattggaaggatcgtccttacaatatgtatttctggagagatgatcaagggaaggaactaggttcttattttaatattgtggggaatacatggttgaacggccagctggtcatgtttgaagacctcattgttgatcttctcgttctaccgaatggtgatttttttgtattggatgaagatgagttgccagagagtttagcggattttgaacaaggttcagtgcgccgagcattagagggtgtgatggcttcgttagaaagcatacttgatcaagtgagggcagatactgaaggaaaatatcatcatagcttattttcaccgctgttaaaatagaaaaaaacgattcctttcagcgaggaatcgttttttctgttaaaccttgatacggtttaatcgtttttgtaaactggttttcgttttagaagcttttagctgtttgacagcggtttgcgctgctgcttttgttttcttcgttcgttttgattccgcttttttcaccttttgtttggcgtctgtcactttcttttgataggcaacctgttttttgactttgtcgagccggttttgcaggcttgttttttctttgcctttgtttagctttttgatggctgtttgagcgcttttcatggcgccttgtgttttgcttttttcggctgtttgaaccttagcacgtgccaagcggatatcaatggttccttgtacctttttcacccgttcagtgagtgctgttttttgtttacttgcagtgagtcggccaattcttgttttggcttgattgacatctgcctgctttttagaagtttcggctgttttaacagcgctggtcgcagcttttacaaaggtggactgcggtatatattgcacgcggccatacccgaattgtggatcttttccttttgtgccaagatccactgtatagctgcgcaataaggtgcgaagctgcacatttgttttcttcggatgaagctgtttcaacagtgccagcatgcctgtgacatgcggcgtagcttgtgatgtacctgttgcataccaatattcattttttaaataagtgctgatgacgttctggccaggggcagaaaattcaatgcctttccctgtatttgagatagacgcgagtttgtctttgtctgtcgttgcagaaacggcaatgacactattgtaagcggcagggtaactaatatgattcttcttcccatcattcccgcttgcagcgaccacaagcagaccttttttatatgcttcatccactgctgagcgcaaaatagggatattgtcttcaaaacctaaacttaaattcataatatccatcttgttgctaatggcccaatcgattcctcgaagtagactgtacaagtcgccttctccctttttatctaacactttcacagcatacagcttcgcgccagaagcgacgccgactgtgccgtaatcgttattgagggcaccaatcgttcctgcgacatgtgtgccgtgtccttcatcatctttataggaggaagtgtagttcacgaatgatttaccgccggatatctttaaatcctcatgtggagaaataccagtatctaaaatggcgactttcacatttttccccgtgacgccttcttttatcgcttgctttacattcagcttttgcaggttgtaagatttttgaaccaatgcatcctgattcgtagaggcagcggtttttttcatcgtagaagaagcgagtttgacctttatgttttttgaaacgtacgcgatgttggggtcttttttgagtgacgtgaccgcttgttcatctgctgtcacagcgacagcgggaagatgtatgtactgttcgttcactttttcactttcttcaatcgctgtttgctttcctttttggtttttatagacgatgatgacatctgtttctttttgcggtgcagctgcctgcgaatggtaaggcaaggcagttgtcaacgcaagaagaaacgcgatgactacgacaattttctttttcaaggcgatagccccttgcatacgatgacctccgtctttttttctctattatatcggagaaatgagagggatggttagaagaatcatattgtttgtcagaaagtttttttacaagtaacctgaaattgaaattcatacaaatctagtagacaatagaaatatcataataagagaaagtaggatatgctgatgaacgtaaaagagtatatgacgtatgatgcgacaggcttggcagcacttgtacggaataagcaggtaacgccagacgagcttgtacaagctgcatttgctagattgaatgaggtcaatcctgaactaaatgcgttgattcagacaagacaagatcaagtattaaaagaaatcaagacattacatacgaatcagccgtttgcaggcgttccatttgtactgaaaaatatatcgcaagggctggaaaatgaaccgctgacagcaggtgctgcattgttaaaggatgtaaaggcaaaaacggactcccactttgtccagcgattgaagcaggctggatttctcatgatggggcatacaaacacaccagaattcggattaagaaatgtaacagaacctgctttacatggtccaacgaggaacccttggcatcctgactattcccctggcggttcaagcggcgggacggcagcagctgttgcaatcggcatcgtgcctgctggaggagcaagtgatggtggagggtcgattcggattccagcatcctttacaggtttgtttggtctcaagccaacaagaggaagaacgccggtaggaccaggcgcaggaaggcagtggcaaggggcatccattgactttacactcacaaaaacagtgcgggacagtgcagcccttcttgatctgcttcaagtcattcagcctgaagcggctttccaaacgccgttatacgacggcagctatcaagaagatctagtgaaacgtacatcttctatgcgaattgcttacagtgtacaatctccagttggtacgaaggtcagtgaggaagcgaagcaggcggtgcagcaaacagtgaaatggctgagtgaacaagggcaccaagtagaagaagcagggcctgcaatcgatggggttcatctgatgcagcaatactacgtcatgaacagcggagaaatgtctgcattattcacgtccttggctcgttcattaggacgtccagtcaatccggaggaaacagacatcgtggcatgggtgttggcggaggctggcaagaacgtaaccgctgctgcttacacagaaagtcttgatgcatgggatatggcggctgcacaaatggcgtcatttcatcaaacttatgatctctttgtgacaccagcgacagcctattcagcccctaaggttggtgagttgatgcattcgaaggaagaaatcactgaacttttacgtgtgtcatctctctcaatgcaagcgcagcaggatctcatttatgacatgttcttaaagagtttgacctacacaccatttacacagcttgccaacttaacgggtcagccttctatgagcgttcctgttcatctcactgaggagggcatgcctttaggtgtccaggttacagcacctaaggggaaagaggattggctgcttcggcttgcagcagaaatggagacatcctcgatttggaaaggaacaaatcaactcatatgttgaaacgacatttgtctatggagggaaaggagtgtcacacgtgagtacgaaggatagaattattcaaacggccgcacttcttttacgcaaacaggggtatcatgcgacaggattgaatcaaatcattagagagagcggcacgcctaaaggatctctttattattattttccaaacggaaaagaagagctagccatagcagccgttgaatatattagtcaaaaggtcatcaatcaaatagaagaaagctttgcctattcgaacgatccttatattgccatcgaccgttttatgacaaacatcatccggggatttacggagcaggaaaatgaaagagggattccgattgtcttgctggcggcagaatccaagccagaacatacgcagcttcatactgcatgtaaacaagaaatgatccgctggcaaaagcttgtgaaagaaaagctcatgaacagtggttatgaagaaaacaaagcggatgagctggcttccctccttcattcaatggtgattgggggtctatcgatgaccacagcactcaaacaaacgaccccgttagaacatgtgaaatgttaccttagacacttatttatgcgagaagagtaaaatctctcgcatattgtctatctattatatcaattggtctatataataaagatagtcaattcgtcatgaggagtgatgggatgtcggagcaaccgcaatcgatcaagcaatccgaaggtacctctttttataccttgtctggttcagggaagctgtatgggctggaaaatcagcttgttcatgtgctggcagaagcaactcgaacgaatcagctgtttgagcttgtcttaatcacaggtgggaaaggagcttattttccacttcactgtcatgagcacttatttgaaaccatttttgtgctggaaggaaagcttgaagtgattttggatggtaaaaaatatatggtcacagccttcgattatattcatattccgcccaaaacgatccatggctacagaatgcatagtcacaaaacaagatttatttcatatacgttgggcggacaaatgacagatgtctatcagcaaatcgggaaaaagcttcagctgaacgaatggccaatgactgatcatgctttcgatgcagccagctttgaacaagctgaaaaagaaagcgatctcattttgatgcatggtatacggcagctgtcaaatacaacaaagccctccgttttatttcatagtcagcttcctcaggcggtgcagccctatgtattagaggctggtgaagggaagcaatatatcgtggatggtcagctccatgagctgatcgcaacaacagaaacaactggaggcgggttcagtcattttgtgattgaaggcgcgaagggaaagtattttcctccgcattatcatcaagtacatacagaagcactctattgtgttgagggaaaaatgaatcttcaattgaacggtgaggatatatgcctgatgccgggtgactttgcctatataccgccggatacaattcactcttatgaattcgtgtctcattctaataaatttttgctattgctgctccctggaaagattgagcagttgtatgagcagtttgaagaatcacaaagtccgagtatatgtccttattttattcaagaagggaacttgatgatcgatcgagagacttcctctcaatatgatttggtctttatcgataaaggataaagatgtaacgcgttacacacatgattgaataagcgcctgtcgaaccgatcgacaggcttttttgttttttcatattcatgatttgatgcatgaaccatcctctcaaggtgaagctatgtacagatgattttcgctaaaggaggaaatgcatgtgagagctgttacttaccaagggaaaaatagcatcgcagtgaagaaagtagatgcaccatcaattcaagatcgggaagatgtgattattcgaattacatcaacagcaatttgtggatctgatttacatttgtatcaggggaatttcccgcttccaatcggttatgtgattgggcatgagccaatggggattgtggaggaagttggcccagatgtcacggcagtaaaaaagggagaccgtgtcgttattccatttaccgttgcatgtggtcaatgccaatattgccatcaccacttagaaagccaatgcgacaactcaaacccgcactacgattcgggtggactttttggatatagtgagaaatatgggaactacccaggaggacaggcagagtatttacgcgtgccttttggcaattacaccccgtttaagatccctgatgattgtgagctggaggatgaacaattgctgttcttatctgatgttctcccaactgcttattggagtgtggagcacgccggtgtgaaaaaaggtgatacggtcattgtgttaggctgtggacctgttgggctaatggcgcagcaatttgcatggcaaaaaggggcagaacgtgtgattgcggtcgattacattgattaccgtctgcgacatgcaaaacggatgagcgtcgtagaagtatttgattttacagaagatcccgacatgggagaaacgttaaaggagctgaccaagggtggtgccgatgttgtgatcgattgtgtgggaatggacgggaagaagtcgccgcttgaaaaaattgagcagaaactcaagctgcaaggtggaacgatcggaccgattcaaattgccacaaaagccgtccgtaaatgtggaacggtgcagatgacgggtgtgtacggcggtctatacaatatgttcccgttaggtgcctttttcgcaagaaacgtcacccttaaaatgggtcaggctccggctagaggctacatgtcaaagctctatcaaaaagtgacaactggtgaaattgatcctagggcgatcatcacacatcaattgccgttagatgatgccgctcatgcgtatcacatatttaatgataagaaggatgattgtataaaggtcatcttaaagccgtaaagaagaaggcttaggaatgttcctaagcctttaatgtgtgttcgtccatcattttctcaattaattcaaaaaatgtttttttatcttcttctgaaagatggttgaacagttgattaacaagcaattggcggttgtcgatcatttgttttgcaatttgttcaccagattcagagagttcaatccatacagtacggcggtcattattatttcgagagcggataatcagcccttcatcttctaagtgattgagagcggttgttgttgcagagggagataatgaaacttcctgcagaatatttttcacagtacatgattgatgacgataaatgatgcgtaaaataaaccctttcacattcgtgacgtttttcgggatgttctcttcatctatttgtttcgtcgcctttaaatactttgtcagcgcatggtctaataaacttgcctctagctcgaaatgttgcattctccatacctcttttcctattgcattcgcattttccgatcaattactaggtctatcttatcataatagttatcatcatttaaaccaaaatggaagacggctataaaattacctatattatcaattaatataaagaacaattccaaactgaaatgattttactttcagctggttttattttagaatgtgaatgagataaaatctgccaacccattcactggaaattggctattgtaaatcaaacgtttggagatgaagatattgaatacactacaggcattacttaacgacagaatggaacgctcatcacaaattgaagcggtaactggcgggggtgtgtcttatacatttgaagaatatgcaaagcgcattgaccagctcgctcattacttacaccaaaaggggattcgaaaaggggaccgtgtttgctttattagtcaaaaccatcatcacttccctacgattatgctggcagtcatcaaagcaggtgcagtcgcagttccgcttagctggcagcttacttcctttgagctagaaggtattttgaaaaaagcagagccaaaggctttattttttgatcgtgaattccgtgacatcattgcggcagtgaatgtgtctttagaagattgcctgatggtggaatcaggtgtcaatgcgaaaacaacacagctgtttgaagacattttggcttcaaatgatggaagtaaccttgctgaagaggtatcagaagaggatctagcgatgattttattcacctctgggacaacgggcaatccaaagggctgtatggtcggacatggacgaatctatcaatttttaacaagacgtgggaatcgaggattcgatctgaaaggaaaacgatacttggcgagtcatcctctgtatcatatgagttcaattaatcatctgatcgcagctgcaattgaaggatatacacttgtcttcttacatgatgcaacaccgaagcgcattttagaaacgattgagaaagaaagaattacgttcatgatggcttttccatcagcttacacgtacatgctagaagaaatgaaacatggctcgtacgatctttcatcttttgaaattgcgatttctggcggtacgaaggtgccggtgcgcttaattaaagattacaaagaagtaggcattcagatgatgcatggctatggaagtacggaagcatgggttgtgagtgcgtggcatccagcgatgggcgaggataaaatgggctctgcgggtaaagtggacccagatgtagaagtgaaaatcgtgcatcctgagacagacgagacattgccagctggagaaatcggcgaagtcgtcatgagaagcccattttatttcttaggctactatcatcagcctgacgctacagagaaggtactcaaagatggctggttccatatgggagatgcaggctatctagatgaagatggttttcttttcatcacaggcagatacaaagatgtgattctgtacggcggggataatatctatcctgaccaagtagaagaagtcattgatcaaattccaggtgtgattgaatcagctgtcattggggtaccggacgaattatatggtgaagtgccaagtgcgtatatcgtaaaagacgattccgtcgatttttgtgaagaagatgtggtgaactattgccaggaacgtttggcagattacaaagtaccctccattcatttcacacaggagctaccaaaaaataagcttggtaaaatcatgaagaaggatttacgtgaattggttgtgaatgcgtagtacctattctgctataatgaaatttgaatgattttttgtttttctaacgttttggagggaaagggtttgcgacatattcttcgtaagaaacacattcacgatttgttagagcagagcaggcagcaaaaggtacagaaaacgctgggcgggctcgatctcacgctccttggtataggggcagtgatcggcacgggggtcatggtgttaaccggaattacagcggctaaggatgcagggccggctgtcattttttcctttgccattgcagcgattgtgtgcagtttggcagcactttgctatgcagaaatggcttcagcgctgcctgttttcggcagtgcgtacatttattcatatacaacgatgggtgagcttgtcggtcatctaatgggatggacgttattgtccgtgtatatgctgactgcttcagctgtcgccagtggctggtcgagctatttcaacagcttgctcgaggggtttggaatttcgattccccatcaattcttagcggggccggaacaaggcggatatatgaatctgccagccattatcattgccttactaattgcgtggatcttatctagaggaacgaaggaaagtaaaaaattcaataatatcatggtgtttgtgaagctcggtattattgttcttttcattgtagtaggcgggttttatgtacagccagccaattggcagccattcatgccgtttggtgcagaaggtgtcattgccggtgctgctgctgtgttttttgccttcttaggatttgatgcgatttctgcttctgcggaagaggtgaaaaatccgcagcggaacctgccaattggcattattggctcattactcatttgcacgatcatttacattgtcgtttgtttgattatgacaggtatggtgcactatacaaaactgaatgtcacagaggctatgtcctatgtgctgcaaagtgtacatcaaaatagcgtggccggtattatttctgtcggtgcggtcattggattgatggctgtgattttcgccaataattatgcagcaactcgaattgcgtatgcgatgggacgagacggtcttttgcctaaaatgttttcgaaaacaaacaaaagcgatacgcctgttgcaagcatatggatgattggcggcatgacagctgttatttcagggtttattgatttaaaggacttgtccaatttagcgaatatcggtgctttattgacgtttgcgatggtgagtttatctgtgcttattttgagaaagacacatcagcagcttgagaggggattccgggttccatttgtgccggtattaccgattatctcaatgggctgttgcttgttccttatgctcaacttaccaggacggacgtggctttactttggtgtttggctgttaatcggtgtcgtcatgtacgcagcgtattcaaacaaacatagtgaattagcgaaatcctcatgagaaaaaggtgcaaatccgttgacgatttgtgccttttttcatacgatttgggataagctataaaagagaagatggacggaacaagaggaggatgaggggtatgattagtgttagtccttatattgtggtagacgatgtgaaggaatctcttcaatattatcaagggatttttggcggggatattcatattttaaatgaacatcaagaccgtgtgctgcatgcagaactgcaccttggagaatcactgcttcacttttcagatacgtttggccgcacaccaaagcctgaacatctcagattgattatgcagtttgacaatgaagaagaactaaaggctgtatatgaagcgctggaagctgatggagatgtattggtcgaattacaggatacgttctttggcgcacttcacggacaagtacaggaccgcaaaaatgggttgatctgggtgctgaattatatgaaataaaccaagaccttcaccttcgtgaaggttcagcgtgtagacaaaccctcgcattcggtgtcagtcctgcgtgctggtgctcacgaatgacaaattcgctccgcgccagtactcatcctttctagactgcaaaggttttctatcacgctgaaaagaagacaaaaggctaaaatcaagatcattttagccttttgtcaacaatctggaccttcaccttcgtgaaggtttttttgggagtgcttttattttctgaaaaatggaaaatatgctatgttggaagaataaaagaacaaggagaaaggtggcaaagcgatggagcaaattgaatttcaatcaatccaaacaaatggtgtaacacttcacacagcaatggctggacctgaggatggtccgctgcttatactgctgcatggatttcctgagttctggtacggctggaagaaccaaattatgcccctagccgaggcaggatatcgtgtcgtcgttcctgatcaaagaggctaccatctaagtgataagccagaaggaatcgaatcctatgtattagatcaactgagggatgatatcgtagggttgattaagacccttagtccgaatcaaaaggcgattgtgggggggcatgattggggcggggcagttgcttggcatttggcatccacacgttctcaatatgtagagaaactaatcattgtcaacatgccgcatccgcgggtgatgatgaaggttcttccgttttatccgccacagtggaagaaaagctcctatatcgctttctttcagcttccgaatgtgccagaggcagcactccaagaaaatcacttccaaaagctggatgaagccataggactgactgcaagaccacatttgttctcgaaagaagatgtattaagctataagctggcttggacgcagccaggtgccatgacctcgatgcttaattggtatcgcgcgatcaaaaagggcggctttgaaaagccgatatctaaacgtattttagtacctgttcgcatgatctgggggatggaagacaagtttttaagcagaaagctggcaaaggaaacgatgaagatttgccctaatggtcaactgatttttgtcgatgatgcttctcattggatcaatcatgaaaaaccagaagtagtgaacaaactcatactcgaatttttgaactaaagaaaaaagctctggtcaggggaccagagcttttgtgatttacccaatatgattctttttcaacgaagcaggttcatcgtcccagcattcaatgttctcatggtttggaacggcatttttataaaagactggatctttcccctcttttttctgccgtgaataatcctttaatgctgcaaaggcgactttggacagcatggtaatggcaatgaggttgacgatgaccattaagcccataaacagatcggcaagattccaaacaaaaggaacacttgctacagcaccgaataaaaccatggcaatgaccgcaatacggtatccaatcaaccaggctttgcttgatttaaggaactcaatgttcgtttcaccatagtaataattcccgatcagcgtactaaatgcaaataagaaaaccataatggcaagaacaccagaagcccaaggaccgatgtgttcactcaaagatgcttgagtaagctcaatacctgttaattttgtcgttttatatgcacttgagaaaagaacgataaaggcagtacttgtacaaataatcagtgtatcaattaagacaccaaatgcttggatcaatccttgctttacagggtggctcgtcacggcagctgcagcagcgtttggtgcgctacccatcccagcttcgtttgagaatagaccccgtttgatcccttccataatgacggcacccatagtaccacctgcaaactgctcaataccgaatgcatgtgaaataatcgtctggatcacaccaggcagttcagtaatgtttgtaatcatgacaaaaagagcaataccaatataagcgacagctaagaagaccacaatgtattcagccatcttggcaatcgtcttgaccccgccgaaaatgatgatactaaatccaatagccataatgacgcctacgatcaaacgatttgtgccaaatgaattttcaaaagcaatggtaatggtgttcgactgtacagcgttaaagacaataccgaaagaaatggtgattaatacagcaaacaaaatccccatccagcgtttctttaagcctttttcaatatagtaggcgggaccaccgcgaaagcctgatggatcttttactttatacacttgggcaagcgtactttcaacaaagcttgacgcagaaccaataatggctagaatccacatccaaaaaatagcgccaggaccacccatggcaattgcgatcgcaatcccagtaatgttcccagttccaacccgagccgccatactaatagcaaaggcctggaatggtgatacgccagatttttgtttatttgttccttctttcagaacgatcaccatttccttcagcatacgcacttgaaggaaacgagacctgaatgtgaaataaaggccgacaataattaatagtgcaacaataatatatgaccatagaaaaccatttgttgttgttaataaaccattcataacatcacctcttctaattcatcctatttctttaaaaaatactgagatcccactctttggcgagctttttcagcatcatgacaccggtaatgctattaccacaatcatcaatggcgggaccataaataccgattccacagcctgtctgaaacgggaattctcttcttgcgcttggcggaacgcaagccataattcctccagacacaccacttttggctggtacgcctacgaaagcagcaaaattaccagatgcattatacatgccgcatgtcagcatcaatgcctttgttagtcttgcgatatcttttgggatgacttggacttgtttaaagggatggtagccatcacttgaaataatgagtccaatcaaggcgatgtcctcagttgtgacctcgatggaacattgctttaggtacacttctaatgtctcttcgacatctgattctaaataattggtttcttttaagtaataagcaagagcgcggttacggtgcgcagttgcccattctgattgataaacctcttcattaacagatggacgctttcctattaagttttcgattaaatcgaaaatatatgctagcttttctgtagaagtctttccgggaaggatggaggatacggtaatagctccagcattaatcattggattaaagggcttccctggtttatgcatctcaagacggtagatggaattaaatgcatcaccagttggctctacatctacccggtccaagacgtaaggaacgcctcttcctaaacaggcagctataaagctgatgacttttgagatactttgcagggtaaagggaacgtcccaatcaccatatcgtacagatgatccatctgggcctatcacgctgataccaagttgagaggaattcacttttccgagtgctggaatgtagccagcgttttgtccatttttgtaatacggacgaatttcttctgcccattgatcaacagaagactggcatgcgtgttgtgtattattagaaattgctgttttcatacgattcctccaatcaaaaatcaaaaagtaccctattgaattggcggatgacaaaaaatgcgatcaaataggcacgaaaacatgttacacatcttcaaagaacttgtcatgcgctgcttgtaccactcctttacacctaaatatatgttcaaatgaaggctttggcggcgaaaaaacaaaaagggtttttagtgaaaattcagaaaacgcttacatatagtttcactaaaattgttcattcaatttatcttggaaactacacaatctgacgaaaatctacagaaaaacttacaaataaaaatcagtttgtcgattattgtctaaacaattcccattattgtagacaatcaccaaaatgctgaatagctgaaaggtcaccatgccatctcggtgaatagtcataaaaaaggattttggggaaataaggagctgtgaaaattatttttttgtacattgtgaagaaaagagtctccttgtatactgtggctatgcaaaaaggggaagggatgttagtcatttgagtttaaaccagcttgttaaaaaagacgcattcatattaatttttatggtggtgattgtgccgcttgcaggagaactgaagttttatcctgtgaatgagacgttccggatcagctttggcgcacctgcgtttttcttttgtttattactcttaaggaaatctagaccgttcttgcccggctttttaacaggcgcagccattgtgctttttcgagtaggcttagatctaattcagcatcatgctggtttcgccgtatcattttatcagcaattcccaagtttctttttctattttacatatgcattcctgttctttgccgtccgtacgggacgttttaaacagcgctctatttttattgggatcattggtctgatgattgaattagtggctgattttgttgagttgtttgtgcaatatttagtatttgatacgacgatgacgctatcaaagctgagtgatatgtttctcattgcgtttgctcacagttttgtggtgatcagcttttttaatatgatgaagctgtatgaggcacaatctagagagaagcagatcatgaaacaaaatgaacatatgatgctggtcatttctaatttatatgaagaaacggttcatttaaagaaaacgttaaaacatacagagcatattacgcaagaatcatacaggctttatcgtctaatgcatgaacatgaagcaggcaaggaagtgagtcaggaactgttgaagctcgcaggagaaatccatgaagtgaaaaaggacaatcagcgtatttatgctgggctttcgaagctgatttctaaggaaaatatgcaagactatatgaatgcggaagagctcgttcaaattgtcctccgcattcaagaaaagtatgcgctctctctagggaaaaacatctcctttacatctgatataaaaggcattcatttgcatgattaccatgtgttcattttcttatcgctcattaataatttaatggcaaatgcggttgaagccataaaggatgacggaatgatctcactcgtattgaaaggaagtcatgataaaatagagattcggattgaagatgatggcccgggaattccagaaaaaatgagagacatcgtatttgatccaggctatacttccaaatttgatgcatatggaacaccatcaactgggattggcttatcctatgtgaaagagctggttaaagagcttggcggtacaattaaaatcgaacaaagagaaacaaagggaacagcttttcagctaatccttcctatacaaaatttaatacagagagggtgagtgtatgcggtttttcattgcagatgatgatcgtgcaatacgctcgattttaggacaaatcattgaggatgaagatttgggagaggtcgtggatgaagccgatgatggagttggattagaagcccattcattgaacctaaaaaaaatagacatccttctgattgaccttttaatgcctgttagagatggcattcaaaccatacgtcatattcaccctgaattcaaaggcaaaatcatgatgatttctcaagtagaggcgaaagaaatgatggcagaggcctatgaattagggatcgaatattatattcataagcctgtcaatcgaattgaaattgtcagtgtgattcgaaaagtcatggagcggattaagcttgagaaatcgatttacgatattcaagcttcccttcgccatgtgctgccgttagagccagtgatttctcataatacgacgggtgctgggttgaagaaaaggacgatgaaagaggcgggggaatttctcttatccgaactaggaattgttggagagagcggatctaaggatttactagagatcttgatctatttacatgaaacacagtcagccaattctcatgaggtcaatttcccgccgctaaaacagctctttatcaaaacagcggagaggaagctggatcatggggcaaccgatgtagaagtgatgagggaagtgaaagcggcagagcagcggattagacgcgctattcatcattccttgaatcattttgcttcactaggattaacagatttctcgaatcctaagtttgagcactatgcgtcgaagttttttgactttaccgatgtcagccaaagaatgaaagaaatgcagaagacctcttcatccgcaggatcaactggcagagtcaatacgaagaagtttgttcaaatcttttattttgaagcaaagcagttatttgagggaatgagctgaagaaaatctattggaatgattggagaaaataaacagaaaaagactgctattcctatgatctatcgagatcttcaagtatctttattatttaactgatcattctgatttttcttttttcttgaaaataaaactctcctgtgcaatcgtttgttaaaatagtgaggttagactagaatgtcggaggttttattttgggaaaaattaaacgaaatgcgctctgcccttgcggaagcggaaaaaaatataaacattgctgtggtcaaaagtcaggcggggaacaaacgtctgagcttgtgtttaaggaagctgtacaagttcaaaaggatttaatgaattacgcattctctaaacatcagaaagccatcaatcaattcattaatgagttttcttttcttgcagatatggataaagaaacgcaacagatctcggtctttcatttgagtgtatggggcatctttttccgtccattaacggatcagaaagaaaccatcttccaagaattcctgacaaagaaagcggaagatattacccgtccgaaaacaaaacaagtggttcaatcatggacaggtatggagccatctttgcttttattaaatgaaaaaacggacgagtctctttactttgagaatatggtgacagccgaaaaggttgaagtagatgtaaaaccggatcaaacagtgctgcctgaaaagggaagtctcgtacttggattccctgttcaatttgaagaaaaagcagagtttttcattcaatatacgatgtttgcgaaagagtttacagatacgcttcttattcaagttcgtcagcttgttgaagcatatgaggcaaatggaggaacgcgcagcacatttatgagagaatcattccctgatgtgttgaagtgtttgtttgcgaagcaagaagtagaagaattagaaacatctgctcaaacagaaggcgatacaggtctaacagcagatcgcatggactgggcaagtgacgttcaactggaaacagctaagctgattgaagacggaatgaaggaacacggggaccaaagcctgactgatggcgctttaaccgtgtggaaggcctattgtgatcagaaatcacctgtgatccgtaaagcagcatcatttgctgcgggaatcgaatattacattcattcacttgcaagtgatgccccgctttctcaagcgcaaatagcgaaaaagtatggcattagtgcgtctactgtatcaagccgtttcaaagatattgaaaaagcggtgaaagaagagcaagaggcgacggtatagcataagaaaagacgcggcaccttcattgggccagcgtcttttttttagttcaagattatcttgttttaataaaaccgctcatgtactgtgatgtattataatcgttaaggtcaattttccactgaccatccccattacgtttcattttcacttcgtattcagccgggctggagactgggggaagcttctcgaattcagatgcgtacaagtttaagcttttcttatacaattcttctttagagcggatcttgccgttgtaaaactcatctctttgcttgtctagcttgtcttttaagttagaggcatcaatacctgttacttgagcgacaaccttcgcctcgtcattagagatggtttttacacttgtttctactttggttttatccttcatggtgtcttgaatccgtttgtacattgacagaatatcacggtcacttacttcattgccgtacatgccggcggttcttttgaagtcttttacgaacatgtcgtggtatttattcacgacatcggattggttgtcacctgttaaatctgcaaattgatcgttctttttgtcaaatacaatgatatccgtataagcggatagcgcttttgcagggttatccagctttttcgctgtatctaatattttgtttccatctaggttgatttcaatcgaatcactgtttttcttgatgctgtcttggtacacgaactgatattttttccctttgtctactaggaaataaagagcacctgtttgagattttcctttgttcaatgaaccgaggtcaagacggtctttactgccgtaaatttttaaatcagatactttggcatcgtcctgataaagggagaagtcagagctatataatgatagagctttgtcacctttgtttgtaatcgtcaggttgacttttagcaccaattcattgtctcttagtgtagttgttgagtcttctggtaacgtatattcgtagctatcgacttttacctctgctgtttttgttgatttttgatcagcgttacttgattttgctgagctctggcaagctgcagagatgatcatcacgaacgaaatcatgaggagtgcacttatttttttaagattcacagttgatgctcctttgcttttctttcgtcatttcattcccgctatctgactatgaaaaaagaaacagataggatggtatattcgggtgttacaggggaaaatctccttatgacgatttgcacttttcattctatcgaaattcaatcatgatgaggaataggttttagtccctatctttgaaagtaatttacataaaaatcattaataaaaggaaatttgtaagtctaatatactggtcaataagaattaatttatagatttattatcagttttaaatgttttttaggtaaaaatcttgaaatgagggtgttactgcttcagagagcaggatacttgaatgttgtaaaggattcatgggaaaataaggatgattaagcagataagggagatgagcttttgaaaaaggtaacgcttggacgaactaatttacaggtgaatccgatagggcttggtacgaatgcggtaggtggacataatttgttcccgaacctgagtgaagatgccggacgagagcttgtggagacagctcttgatcaaggtgtcaatttcttagattctgcttttatttatgggctgggccgttcagaggaattgatcggtgagattattgccaaaagaggcggtagagaaaaccttgtccttgcgacaaagggggctcataaagaagtaaacggacaaattgagctggataacagccgggactttttaagagagcaggtcgaacatagcctgaaacgactgcaaacagattatattgatttatactatatgcatttcccggacggccggacgccgctggaagaagtagcaggcacattaaaggaattgaaggatgaagggaaaatcagggccattggtgcatctaaccttgattttgaacagcttcaagcctttaatcgagatggctacttagatgtgcttcagtcagagtattctttgctgaaacgtgaggcagagcaggatcttctcccatactgcgtcgagcatcgtatttcctttattccttatttcccgttggcgtcaggtttgttgactggtaaatttacgaaggatgcgacatttgatgatattcgagcaaaagatccgcttttccaaggcgaggcgttccttcaaaacctcgaaaaagtagacaagctaaaggcaattgcacaatcaaagaacgccgaaacggcacacgtcgcactcgcttggcttttagcgcaggacggcatcgacgccattattccaggtgcaaaacgagctgagcaagttcagcaaaacctaaaaacaaacgaagttcaattaacaaaagaggaaatcaatcaaattgaccacattttctcttaatcaaaaaaggtgcttagctgcacctttttttatgacatcgtgagggggattttgatgacgagccgcaaatgtggagaacggtaagtaaaatcaagagtaccgtctgccttttcaacaagctgatgaatgatatacgtccccattccttgatgatcgccgccttttgtggagcggccaaagtttttgaacaaatggtctaacacgtgtttttccattccttttgtgctgttttcacaatggattaaaaagagcccactccgaatagaggtcgcaatcgagatgctgccctctttcccggcttgcttcgcttcaatcgctgcgtctagggcattatcaagcaagtttccagtgaaactaacctgatccgccttagaaaagggaagcgatgaaaaaggtgcttgaaggtctagagaaagggcaatgtcctctttttcagcccgttggaaaaaggaatgcagggttgaggccaaataagcattttctcctttaatccaagggaaatgtttcacgtattgctgaatcaaatccttgatctcatgctcgtcgttcgacgcggaaaaggcatttaaatgtctagctgtttcatgatgtttactgcgcagctcaagcagcaattcattggttcttgattctgcgttgatcagttcttgaagccgaccgtttaatcgtctctccgtctgcatcatcttcaatgcaaggatatctgttgtgatgatgatcacaaaagccaaaagagggctccatccatttccttgcgtcagaaaaagggaaaggcctgcacaggtaaagagcacaaaagcacccaacatcacataaccactcacatgaggcaaaaaccttttgtatatgaaaaatatataaagacaaatcacacaaaaagtgaggagccacagcactcctgatgatagatgcagaaaagcttcagctgctgcatgaaacgcaagacctaggcatatgagagcatacatgcggaatccaacatagaaagcgttcacgttcgttctccttaaaaatagtatttcttaaagtattctaattgctgcttggtcatcatggcttttttatctgtaccttcaaaagacacgataaatgaatttttggcatacgccgagaagttcttaatgtaatgaatattgatgataaacgatcggtgagagcggataaaatctttttcagctagatcgccctttaactcgtttagtgtctgatatgtctggatttctcctgttgttgtgacaatggtggttgacctgcctgttcgctcaacaaaaatgacatccttcttttgcagcacgtgaatatctgactgctgcttaatgagaagccgtccatgaatgcttttctcctgcttggtggacaagtagcgctctaaggatttggcaattcgatcggcttggtagggcttcataatataatcgtgaacatttaaatcaaacgcatggaccgcatatccgctgtttcctgtcacaaatacaacatcgacattcagtgcatgagagtgaatgagatccgctaattcataaccggacattccgggcatttcaatgtctgcgaacaacagatcaatatctccttttttgaccttctcgtatgcatcctctgctgactgtgtgacaaagacaatctccacagcctccattctgcctacaatggcatgcagcttttctaaatctactcggtaatcatcaacgagacctacttttatcataaaaatcacctatgactcttcttattatttgtctattttaccatttgtttttttaaaatagatcatttcaagacagaaaaaggacgtttcgcgacatttttatgtcaaggaagcgtcattttttctatcatagacttagaaagttgaaaggggcgaaccacatgattactctcagcgattgcagctgctggtttaaagataagaaaaaggtcgtaaaagcgatgaagcatatgacgttctccgtgaaggaaggggaagttgttggcatcctaggagaaaatggtgcagggaaaaccacattattacgcgccgtagccacattattagaacctacgcacggaacagtcactgtcgcaggctttgatacggtgaaagaatcaacagaagtgaaaaagcgaattggtgtcttgtttggcggtgagacgggactttatgatcgtttgacggcacgagaaaaccttgaatactttggcaaattgtatggcttagatcagcatgaaatcaaagcaagaatagaggatttggcaaagcgttttgggatgagacaatacatggatcgcaaggtgaaaggattctcaagaggaatgaaacaaaaggtggcgattgccagaaccttgattcatgatcctgacattattttatttgatgagccgacaacaggcttggatatcacatcaagtaatattttcagagactttattcatcagctcaagcagcaaaataaaaccatccttttttcaagccacatcatggaagaagtcagccagctttgtgacagtgtcatgatgattcatcaaggagagcttgtgtataaagggacacttccagaattatatacacaggaacaaagtgatgacttgaactatatctttatgtcgaagctcgctagggggatttcataatgtggaaaaccgtatttaaaaaagaaatgacagatgcgctaagagaccggaaaacgctgctcttaacagtgctgattcctcttttgacgatgcttggattggtgttcttttatgaaagcatgattgcagatccaggagatgaaacctatacggtcgcagtgaatgaaaagcttccaactgaaatgaatcaaatggtcaaagaggtcaaaaacctcacacttgaaacatttgatgacccgcagcaagctgtcaaagatggaaaggcgaatgcttacctggaaatgccgaaagaggcagacgacatgcttcagcatcaacaatcatttgcaattaaaattcatgggtatacaacagatgatgattcggtcatcacggttcaaatgctgcaatccttattggagcagtatcaaaaccaagtcgtagaaaagcgtttagccgctgatcaaattaatacgtctgttgttcacccatttcaggtgcaggccgttgatgtagaagagggcgaagaaggagaaaatggcatgacctctatgcttttgtcgattcttcttccaatgattttggtgacttccgttatctcaggtgccttgcctgctgcgcttgatattgtagcgggtgaaaaagaccgaaaatccattgaagcgttgttcctgacacctgccagcagactccaaattctcatcggaaaatggctggctgtctccatgttcgggattttaagtgggattgtggcgatcggtatgctgcttttatccacgctgctctttacagaaaagctaaaacaagcactgaactttggtgatcaaatgtggagcattatcgccgtcatgtttgcggcgcttatcatcttctccttcatggtatcgatgattgaactgctactcagtgtcgtttcaagctcagtaaaagaagcacaatcgtacatgtccatgatcattacattaggtgtgatcccaatgttctttaccatgagagcaggtgctacgcagctagatacgtattactttgctgtcccattccttaatattcatgcgctgtgtaagcaattgatgtttggtatcatcgatccaatgtcaatcactctgacactcggctcctcagcactggcagtcgttatcctgtttgtcatcgtcagaagcttgtttatgaaagaaaaatggatgcttgcgaaataaagaaagtaaaaacttgtagattttatctgcaagttttttatatccagagatttatataaaagagattcacgatcgggtgaaaggaatggcataatggaaggcggaacttacattattatcctaattttttaaaaagaggtgattcgtgtatgtcttatcaaacagaagacgatgatgtgctagagctatgtaatatatatgctcaacaaacacaccattttgaagcgtttattttggggaacaggaaaggattattggaattaagaaaagcgatagatgaggcattagaaacgggtagttccgttgcacatttatatccatctgattttgaaggatatgaaacgtatattgctttagtagacgatgagcaaaagtttgagaaattaatggatccttatgtagaggaatacgcacaagaggaggatgcggttgatccggttgaggtgataaaagagtatgaagcagcaaaagaaaatccctcgtaatagaccgtatcttactttcttggctgtaattatcaaacgaaaaacgataagaaaaaacccccggcatcgggggtttttcattagttcttgatgaacttttcaactaatgagcttgttttgtaatcgttcaaatcaagtttccattggtcgatgtcatttttcttcatgttgacttctactgtttcttcagaagatgatggtcctaattttttgaactcttctgggtagatcgagagtaaatatttttgtgcttcatcataagacgcagtacggtttttgctgtagaactcagtcgctttttcttttagacgatcgacaagcgggcttgcatcaattggtgtaagagttacagtcacaacggctttatcaccactgatggcttttgtttttgttgatacttttgatttttcagctaatgtttcttttacagcttttaaaagcttatcaaggttttcgtccttcgctgagctagaagaaatacctgatgacgtgatgtagccttgtttgaatgatttatcaaattggtttacaacagttgatttgttatcacctgttagtttttcgaactcgtcgttattcttaccaaaaatcatgacatcaatataagaagaaagagcttttgcagatgcttgaagtgtttctgcttttttcattaagtctttacctttaatatcgaattctagtgttttgtcatcttttttagaaccactacctggctcattgtacacaagctgatagtctttttctttgtcaacaacaaagaaaagaccgccttttgatacttttcctgcatttagagagcttgaagataatacttcgttgtagtcatctggagagatcgtagacacctgtgagtcatcttggtaaagcgtgaagttgcttttatcaacatttagaggctctttgctgatattttttacagatacgttcacttttagtacatactgatcatcctgtacagatgtatcgtattgaggtggtaatgtgtactcagcactttctacctttacctctgctgcatcaagggattttgtatctttttcctttgcagctgacttttcttttccaccactacaagcagcagcgacaacagtgacacacaagatcagaagaaacagggataatttctttttaaacatgagatgttttcctcctcgggttttatggtgaatttcattggaaatctttagttcatatcattctttttgcacaaaaagaaaaatactgtatgttttttactgtagaatgaagcgaaagtactgtcaatacttcagtgcgtttcttaggttgcacagcttcaaatagtaaaaatgacactaagttgaaaggagaaacttgtaaattatgatttgatatctcctgtaaaaactcaacattttatattttaaggttttgagtcggattgttgaataggttcaaatgactgtttttgataatggtgtagcaattagaaggatttttatgacttgtaaatgagtctatagtaatgaatattttttcctgttatgcgcatgattacttggtttgtgtgttgttgccagagagacacatgtccagcaaaatattgaggtatttagacaggctctcgacattgaatgtgtcttttcccgtcaaaatggcagtcatctacacagaaaccctacataaaataaaagagaaacgaatggaggtggatgtatggcagtggtaagagcgacaagctctgatattgatctcatggccagactgctgagagcggaggcagaaggtgaagggaagcaagggatgctgctcgtagggaatgtgggcattaaccgattgcgtgccaactgctctgactttaaagggctgcgtacgattccacaaatgatttatcaagagcatgcatttgaagcagtcacacatggttatttttatcaacgagcacgagaaacggaaaaaacacttgcgcgtaggaatattaacggagaacgattttggccagcaaaattcagcctttggtattttaaaccgcctggtaattgtccaccgacatggtacaatcagccgtttgtggcaaggtataagtcgcattgcttttatcagccaaccgctgaaacatgtgaaaatgtctataacaccttttagcttgatgaacagcacaatcctcttagtcaacgattgcagagggttgtgtttttctttttttcaaaatgggtaaccattgtgtatcaactagatgaagcacgtgataggaggaaataaagatgtatcaagatttaaaaggaaaaacagccattgtcacaggttcttcaaaaggaatcggacaagccatcgcattacgatttggacaagagcagatgaatgtggttgtgaactataaaggtgatgaagagggtgctgaagaaacggtacaagccattcagcagaatggaggtagggcggtgaaagtacacgcggatgtctccaaagaggaaggaattcaagcgatcatggatacagcactggagcatttcggtacagtcgatgtgttcgtcaataattcaggctttaatggtgaagaagcgatgccgcatgagatgacgctcaagcaatggcaaaaagtcattgatgtcaatatcacaggtgcctttttaggggcaaaggctgcaatcgcctatatgatggagcatgacatcaaagggtccattttaaatatatccagtgtccatcaggaaataccgcgcccgttcaatgttcactattccacttccaaaggcggaatgaacatgatgacaaaaacgctggcccttgattatgcggaagcaggtattcggatcaatgcgattgcaccaggtacaatggcgaccgaatcgaatgatgatttgcaggatgaacagaaaaaacaaaagcagcttgaaaagattccaatgagagcatttggcgaaccgaaggagattggatccgctgctgcattcctcgtatctaaggaagcttcgtatatcacaggcaccactttatttgtagatggaggaatgacgctttacccttctcaaatcaatgattaatccaaaaaacatccgcccgatcagccggcggatgttttttgttcgtagcggtgtgcggctttggctggtttgccgagcagcatcgggtacttgctcaggaaggagatacacggcaccataagcagcaatgtcccaatcgtgtaaaagagagtccaagagagctgcgctgtatctgcaatattgatgccaagtccataataaacaaatgctttcatgatatcgatgccggcaaactgcaagacaagaataacaatggaatttcgaccgagatacgtcaaaataggggacgttttgaatttgaaacttaaataaatcacagcagctgaaccgagcagtgcacatgcatagaaaagaaaaagatcaccatagtcattcacgcgcatatcgatccgcgaattaaagctttgcatgtaagccgtcagtacaagcagacctgtacaaagaagaagggttgggtctgtttttaattccacaaaccattgctttgccaaaaatccgattgaataaaacacaacagccgtcaaggcgacattggcattccacggcagactttggtttaaaagcaaggtagaggcatatccagcacctccgcaaagaagggtcagtaagctcaagacagcaggtttcccttttgtcagacggtgcataaagaaaaagattatttccactaaaaagagcgtcgttaaaaaccagatggctgggttatgtgtgagcctagcttcatctgcattggatataaaaatacctgtaaacggaacgaaagggtcaatatccgtttgtcccttaaaggcaaaaaaacgagtaacggtgaaccagaaaacatacgtaatgatggagaaatagagatagggcaagagtaagcttttggctttcttctgaataaatgacagagcagggcgtgaggatgatcgaaacatcatgcctgatagtaaaaagaaaagcggcatatgaaaagagtaaatgaattgcttgagcggatctggaatgggcacatgcgccatgaccacgagaagaataccaatccctttagccgcatcgacccagtcgagtctcttattcataacctgtcatctccttccttctagcgtcgtaaacggttcttttatatgtacctctactatataaaaggtacaccccttatgcgtttacagttcgctaacgattagaagacacatttgcgattagatgacaggcggaaggattttgacatctctatgttacatttcccattttttatgacaatgtaaaaaaagaagccaagggaattggcatcaaaataattctgcgattcgtttgaaggagcgctgtttttctatcggatcaaatgaattgttgagaatcatgatgtcatccgtttgatagcggtccatcaagctaagtaattgctctttcactgttgcctttgagccgacgatcatccgctggcggtttagtaacacttttttcttttcctgcgaggtgtagtgataagtactggcttcttctatagaaggtacgcggctgtccagtcctttttcaacacgcagcagccataaatctgtactggtggcgatccgttcggcctcttcatcggtttcaccacaaatgacaaacacggcaaacattgcgtgcggctgtgtggaaaagacagatggagaaaagtgagaccgatacgtctcaaatgcttgtttgccgcgtgcagggtgaataaagtgaccaaaaatatagttgatcccaagctccgctgcttgcatggcactattttctcctaaaccaagcagccaaaccggcggatgagtatcaatatgcggagaagctttgaccccagcatgcgggtgtccagaaggcaggctgtctgataagtaaaatagaagatctttcagctggcgatcaaactgagatagatctttatgcacgccgtctgtcaaagccagtctcgtcctttcaatcccgcccggagatttgccgacaccgatttcaattcgtccaggatacagagcctcaagctgccgcgtgacctctgctactttaaaggggctgtactgcggaagtaaaatgcccccagacccggtacgtaaggtcgatgtatgagcggcaatatgtgccattaatatttcaggtgctgtactagcgagccctcttgtgctgtggtgttcagcaaaccaataacgctcatacccaagagcttctgcaagctgagccagtttcgttgtgtgaatcaatgtctcttgtgctgtctgacctttaggaatagcgacttgatctaatatgtgaagtgatggcatcatcaacatcctttcggtaatacgttgaatttaagtataaagaaatccttgaatagaaggaaacgaaagggtttatcctttgatctcatgctttaacttttctatatcaacatatgaaaccacatcaatacgttatttatcagcaagagctgtggacgggaattttcgacaatgtttcacatgaaacacttcatttacgacataaactattttcaacatggatctttcgttaaaaaaatatcatctgtttgaaacctatcttgaacgtagatcgtatatactagtaaatagaaaaaagagtaagaggctccaaggtcatttcatgaattttgtcgaattttcatgtatgatgattttaatagagtccatcgcttaataaatagatttttattatgcttgaggagtgattgatttggcgattacattagaaaaaggtcaacgtattgatttaacaaaaggcaaagcagggctgacgaatattcttgttggacttggctgggaccctgtatcacaaggcggcggatttttaggtaagctgtttggcggtggaggcggcgctgatattgattgtgatgcttcagtgctcatgctgaaaaatgataaatttacggaaaataaagatttgatttattttggcaacttgaaaagcaaatgcggcagtgtagagcatacaggtgacaacctgactggtgaaggagacggagatgatgaacaagtcctcgtcaacttaagaaaggtgccaggcaatgtgaataaattggtgtttgttgtgaacatctatgatgcacttagaagaaatcaacattttggtatgattcaaaatgcgtacattcgcattgttgatcgttcaaacaatcaagaattagtaaaatataatttaaaagatgagtatgcagggaaaacatcattaatcgttggagagctttatcgtcatgaaaatgattggaagtttgcggctgttggaaacggtacaaatgatgcgaagcttgccgatattacgagaaactatatctaatcagaagggagagattcctagtgggaatttctttagcgaaaggtcaaaaaattgatttaacaaaaacgaatccaggtttaacaaaagtggtagtaggtcttggctgggatgtaaacaagtatgatggcggacatgactttgatctagacgcaagcgtattccttttagatgcagcagggaaagcaaactctccatctgattttgtcttttacaatcaaacaactggcggtggcggaagtatcgtacatacaggcgataaccgtacaggtgaaggagatggagatgatgagcaggtcaatgttgatctttcaactgtaccagcgagtattgagaaaatctccttcgtgattacaatccatgatgcagaagcacgcagccaaaactttggacaggtttctaacgcttacgtccgtattttaaatgcggcatcaaatgaagagctcattcgctatgatttggcggaagacttttcaattgaaacagcgattattgtaggtgaattataccgtcatggcggagaatggaaattctcggctgttggatcgggctatcaaggcggacttgcccgcattgcaacagacttcggtttagatatcgggtaacgacccgttttcatattttcaggagacaggagagatacgaatatggcgattcagctttcaaaaggacaacgtgtcgatttaacgaaaaccaatccagggctgacaaaggtgatgatcggacttggctgggatacgaataaatattctggtggagccgaatttgatttggacgcttcggctttcttagtggatgcaaacaatcgttgtcagcaagatacagactttgtgttctataataaccttcagcatccaagcggcagtgtcactcatacaggtgataaccgtacgggtgaaggagatggagacgacgagcaaattctcgttgatttctcgaaaattcctgctaacattgatcgtatcggaattacagtgacgattcatgatgcagagacgcgcagccagaattttggacaagtctcaaatgcgtttgttcgtgttgtaaatgaagagggcggggaagaattgattcgctttgatttaggggaagacttctcaattgaaacagctgttgtggtatgtgaactataccgccacggaagcgattggaagtttaacgccatcggaagcggattctctggcggacttgcagctctttgtcaaaattatgggttagaagtataaacgagagaaatcaatcgattcaagaggcgctgccaatgactcatatgaggaccttttccaaagtgagaaagaaacagcgatcaagaataacagcaggcgaaagcctgctgatgcttctacacttataggaggaaaaccagttggacattttgaaacatatgttggacacctatgcctcgttttttgattggcatatgtgggcagaggtattaacaaaccctgtctcttggggactcattgggacccttgttgtgcttgaaggattgttatcagcagataacgcacttgtattagctgtcatggtgaaacatttaccagaaaagcagcgtaaaaaggcattaacctacggattaattggcgcttatttcttccgttttctattcattggcgtagggatgctgcttattaagttctggtggattaaggttctcggagctgcatatttagcatggcttgtcattaagcacttctggttaggtgacggcgatgacgaagcgaaggaattgaaaaaagaaggctggatgattcgtgtatttggcgtgttctgggcaaccgttatttctgtggaaattatggaccttgccttctcggtggacagtattcttgcggcattcgcagtatctgaggaagtatggattctgctattagggggaatgcttggcattctcatgatgcgtacagtggcacagttattccttgtccttattgaccgtattccagagcttgagaataccgcgtttattctcatcgggattattgccatcaaaatgggcttaagtgctgcacatattgaaattccgcatcttgcattctttgcgattattattctagcgtttatcgggacgtttattgttcataaaatcaataagaagaaacatcaagatgtgacaaacgaagctgcggcttcaaaagaagaataggatgatcaaaaaggaatggagttgactagaggctccatccttttttgaatcatcaggttattgattttctctaaacaacaggaggtggcacagcatgcggtattttcgatttttatcagaggcgaggcagcaagatctttttttcaagcggccgggggcgatgcattcacagacaccgaggcatgtacttgcgcatgcattaggtgctactttgtatatgcctgcgacacgacaagatatagcagatatgctgctgtcgcagaaatatgaagcgctttgctctgttgtattttgcttggaggatgccatcggtgatcaagaagtggacatggctgaacagaatctagtggcacaactggccagtctcaaagagaaagtcacgcaagctcctgaaacggctgcacatttgcctcttatatttattcgcgttcgttcaccgaaacagctgcttaaaatggcagacttgctcggttcctctcttcaattacttaccggttttgtgttcccaaagtgctcggtccataatgcgaaggattatttggacagtctgaaacaggcatcgtcccaaacgcagacagtactttatgggctgcccattttggaaacacccgatttactagaaaaagaaacgagatatacggtgttgtcagaattaaagcagatctttttgaatgacgaggaatatattttgaatattcgcattggggcaacggatctttgcggtttgtacgggattcgccgtgatcgtgatacgaccatctatgagatcaatttgattgctgatttgatcacagatatcatcaattattttggccgttcctttgtggtatcaggtgctgtgtgggagcattttggccctgcacgaaaggaacaaaagccattcatacgggcactttctcataagagtggtgaatcgtcttcatctgaatttgatgacgtacaaggtttactcaaggagacaaaactcgatgtggctaacggcattcatggaaagacggtcattcatccaacacatctcaaaccggttcaaagcatgtatgttgtaacgaaggaagagtatatggatgcattaagcattcttgaacatgcagacggcacagttggcgtaatgaagagtactttctctaataaaatgaatgaaacgaagccccattacaggtgggcagagcacattttaatgaagtcagatatttacggggtgtttcatgaaaatagaagctatatcgacatactcacagaagcagaagccgcatacgctgagcatcttggaacatatggaagttgagcttgatctcaaagaaggtgcgcttcagctagaaaaagagcatctttttgacatggctgcaagggtgaacaaaaaaagagcctttttattcgttagtaaggtgcttggtaagcacattcctgttcatccagtaaaaccgctccttgtctcgggccttttagccatggcgtatgccaaagagcaaacaggcaagacgtctccacatcaagaccttttggcagaagcactcaagacagatgaccacacggtattaactaaagcctatgaagcgctcaaaaaggagaagctctcagtaggaaaacagccgatcgtgatcggctttgcagaaacagccacagctcttgggcacggtgtgtatgacgtattagaaggtgcatcttacattcatacaacacgtgaacagctgctggatcttgatccttcattggtatttgaagaagagcattcgcatgcaacggatcagctttgttatgcagacgaagcattacttcgcacagaccgtcccatcgtgctagttgatgatgaagtcacgacaggccgtacgaatatcaatatcattcgggatcttcatgcaaagcacccgcggcattcttacacgattctgtctattttagactggcggacagaggagcacgagaaagccatgtgtgagcttgaaaaggaacttggtattcacatcacttcattgtctttattaaaagggcaaatggtctttcggggcaaaacgctggatgaaccagcttattcgtatgagattgctgagcaaaaggatctgccaaatctctcttttcactctcttcaatctttctttcagcaagtgccatatgcacgttctcatgcaaccaattcggctggtcattcgccatatatacatgaaacgggccgttttggtttaaacgcagcagatacagcagccatcgaccaagcagctgcagaggctggactgaaaatgaagaaggaacgcaaaggaaagcagacactttgtttaggaacaggtgagctgatgtatgtaccgatgagactggctgcatatatgggagagggcgttctctttcattcaacgacgagaagcccaattcatcccgttgaaaaggatggttacgctgttcaaaatgggttcacctttgtaagtccagaggatgcccgaattcagcactacgtgtacaacgtaccaaaaggtcaatatgatgatgtatttctcttctttgagaaaaaggtctctcaggaggcattgcttccgcttgttcatttatttgctgagcggcatgtgaagcatgtgcatattgtgactttatcagacgaggtgaaggtgaatggctaatgtgtatacaaagatgggaagctatccagagcaggatgtaaccttcttactcaaagatttatcatccattgagatggagaaaagtacagaggagcgggagcgttccattcagagtggtgcgcattattcagaaatgctgccgattgaatataaaccgacgaaatcttatatggatttattctatgaatctctgaaagaaagtaaggaaaaggtagcagaagcagtagctgtagtagccgaacagattgtgaaaaagcgaggcttccaaacggtactttgcagtttggctagagcgggaacgccgattggggtgctcatcaaacgatatattcgaaagacatatggtcttgaactgcctcattacagcatttctatcattcgtgatcgaggaatagatgagaatgcgctgcattatatgctcaaggaacatccaggctatgagattgcctttattgatggatggaccggaaaaggtgcgatttcgagagagctccaaaaagcggtgcttgattttgaaagaaagtacgggattcgtctttctagtgaactggctgtactcgctgatcctggctattgtacacatgtctacggaacgagagaggactttctcattcctagtgcttgcctgaattcgactgtatctggacttgttagtcggacggtactaaacaaccgctggatcaatgccgatgatttccatggggcaaaatattatgaagagctgcttgatgaggatgtgtccaatctgtatgtggatacaattgaagaagccttttctagcctcgaaccaaatatagaagagaaagcagagaccatcctcacgcaaggaatgcctgcggattggcgggggatggcgtccattgaagcgatcggtcaggagtttcaaattgaaaacacccatttgattaagcccggtgttggtgagacgacccgtgtgctgctgagaagaatcccttggaaaatcttgatacagcctggatctcaggagaagctaaagcatattttgcttctggcagaggacagaggcgttcctgtcattgaatatgaaaatatgtcctatacgtgctgtggactcattcgtccgctggagcagatgtcatgaagacaagtgcgtttgccagtgatttagacaggacactgatttactcacatcgagtgctggatcaatatgagtatgaaggagattatgaattagttgagatgctagatgaacgtccgctttcctatatgtcggttgaaacgaagaagtccttacagacgattcatcaattgggctggttcattccagtgacgacaagaacgaccgctcagtatgaacggatcaccttctttcagcaagagatcaaaccggagtatgccgtcacgacaaatgggggctgtatccttcatcacggcaagccgcttgaggattggcaggtcattgttgatgagaggctcaaagcgtgtatgtcagtcagagagatgctaagagccatctccgaactgccagttgcggcatgggtgaagcgtacccggacagccgagggaagatttctttatttgattatgaaggatgagtatctgtctcgcattccacttgctgaattgaagcagtggggtgaggagagaggttggcaggtgtctctacaagggcgaaagctttattttattccggcaccgctcaataagtgggatgctgttgcttttctaaaggaacgtctggcgcttgaatatgtatatggtgcgggtgattccctcttagatgcaggactcattcgacaggcagatataggctttgccccaaggcatggagaagtgctcgactttgatccattgcttgagccgacagcagcatctggcatggcagcagcagatgaaatcacggcttgtgtcatgaagcagatgacaaccgcaaaaaagccttcgattcgatagcagaagtagaagggtgaatgatatgatagtagtagctttcaagaaaatataggagaaaggaaggagcggcgtgagttataaagaaatcaatattaaccaaacacgggcggagcaggaagcctggaaaaacgtgctgaaaaagccgctccctgaaagagacggttatgtaaaggacgagcatacattgtccttgccgcgtctcgccgcccgggtccttggaactccacatgatgcaaccgattattttatttatttacatgaattatatgaaacagatggcattcatattttaagtgaaacgctcaatcgtcatattgagccggagcattttcaagcgcttcaacgcattcatttgattaaccaagaagaaaagggattgtccgtgaatcgctttgtggctttcttagatggtgaacagctgattgtacgccatccaaatcctgtgatgaaccggcatatccgcctttcattgattaaggtgtttgagcatttcaaacagctgcatgaagggggatttcagcatcccgattttcgccgggttttgctggatgtagtaaagttctcaaataatcatctaggtccatggctgaaggaagtcaatatagaagaaaaaatgccggctgtcatttggtatggagaggcgaataaaagtcagctttattttctttactatgtcatgctgattggctgtgatgttgtgctatttcatccagagggcgaggattcattccgcgaactagatccagaagaaaagctgacttttattgatcagtatccggggacttcaaagctggaaccgttccctactgaaaagcctgagaggaaatcaacggtggcgtaccgctcgactagagagcttgaagaggtgctccatacggaagattcaatgctgtataagccgtggcaattcagagatcatacccctcattctattacgctgaagacaacgtatgatgagctgtttttaattgcaaaggaacgctcctttatccgccctaattttcaagcagaccgtgatacgatacagattccgaatctctttgcgaaaatgatgggggtcacacgagacaagcgtgaatactgggatcgtatccacacgttaatggaatggaaagagacgaagaccattcgccattttccttttacgaaagaagtgtcttcgaattatcaatttcattatcagcatgccctttcgtctgctggagagattgatcctgaattattaatgaaaagcaatgtgtggcagttttctcatctatatgaggggacgcagcgtgcgatagcagaggcggtatctcgaatctgtcagcatccgaagctattaaaagaaggcaatgagactgaatcagatgtccgtatttatttattcaaacaggtactgcatatcggccaggagctcattgaactcattcaaacttttgattatgcacaaaccgtaccgaaagtgattttatatcatacggaatataatggtgagctgactcgttctgatgcggctgccctcatttttctaaatgaaatgggtgtggatctcttcgtgtatcatccgtcgggataccagtgtatcgagcggtatatagatgaccaattatttgatacccattggcttgatgagatggtcatgaaccaggagtttaaagagccatccatcgtcagaaaattatttcaatccattaaaaaccgataaggagatcaaagcttatgacaaatacaaacggaaatgacatcatttcaattgataaagaggaaatctccattgagaaggcagacgatatccgcgttcagcttcgaaatgaaccagaagtgcaaaatattgcaagacagatcgatgcgaaaaatcaactggagctgcttgaatacggaaaacagccagccgttgaaatctctaagttctctgatcgtattctttcgatgatgcgctcaactagtgtcactgactcaggaacgatgctgacgcagcttggaaaaattatggatcgttttgataaaaatgattttgacgagccaaagggtggtttactgtcaaaaatctttaagcgcggcggcagcatgattgaaaagattttcagtaaataccaaacgctcggtgcagaaattgaaaaaattaatgtggaaatcagtaaatataaagacgaaatgaccaaatcgactgtgacgcttgaagaaatgtatgagcataacattcaatactatatggagcttgaaaagtatgtcgttgcaggtcaaatgaaaatcgaggaattaaagcaattggttccttcttatgaagaaaaagcagctagtggaaaccagctggcacaaatggagcttgatacacttcgtaacggcattcaagcgttggaagagcgtgtatatgaccttgatatggcacggatggtggctcttcaaacggcaccgcaaattcgcctgctgcagcgtggtaatacgaaactaatcggtaaaatcaactcagcgttcatcatcacgattccgatctttaaaaatggcatcattcaagctgtgacagcgaagagacaaaagcttgtggctgattcaatgagtgaactggatagaagaacaaatgaaatgctgaaacgaaatgctgaaaacatctcaagccaaagtgtggagattgccaaattgtctggacgtccaagtatcgacattgaaacgatcgaatcttcctttaatacgattgtacaaggaatgaaagagacgaaacagatcgaagaagaaaacaaacgattacgcgaagatggaacaaagcgtatgcttgaattgcaagataatattaagcgagctgccctagagtcctaaaaaataagctgtctgtaactaaagttgcaggcagttttttaatattttaattaaaatttgaatgaaaaaggtttctatgtgaccattttcgggtaaatcctgttcaggggaacggttcacccatgtttgaaaaagtccgctatggtgaggattcgagttattttttagcacaattaggaatttcaagtaaaatattgtctgatgagaggaaataccccgtaaaatatgttgtttatgaagcattctataggatttacgagtaatacggcgtataaactctaatcaccagacctcttatatggaattcatacatattgtgcggaaataagcgaattctaaagattgttcgcatcataacgcttatgttacggttattaagatgctaatttggagggaaaatatgaattctgaagagagaactatcaaaatcaagataaataatgtatctaaaattttcggtaaaaatgctaaaaaagcatctcaaatgcttgaaaaagggaaaacaaaaagagagatcctaaaagagaccggcgcaacagttggtgtcaatcgagcaaattttgatgtgtatgacggcgagatatttgtcatcatggggctatcagggagcggaaagtccacacttgtgcggctgctaaataggttaatcgaaccaacctccggagaaatatatattgatggggatatgataacgaatatgtcaaaggatcaattgcgtgaagttagacgtaaaaagatcagcatggtcttccaaaacttcgcattgttcccgcaccgcaccattcttgagaacacagagtatggtcttgaattacaaggtgtagacaaagaagagcgccactcaaaagcgcttgaatctttaaagcttgttggacttgaaggctttgaagagcaatatccaaaccaattaagtggtgggatgcagcagcgtgttggattggcacgtgcattagcaaatgatcctgacattttattaatggatgaagcattcagcgcactcgatccattaattcgtaaagacatgcaggatgaattgcttgagcttcatacatctgtagggaaaacgatcattttcattacccatgatctagatgaggcgcttcggattggcgaccgcattgtgctcatgaaggacggaaatatcgttcaaatcggaacaccagaagaaattttgatgaacccatcgaatgaatatgttgaacgtttcgttgaagatgttgacctttctaaagtattaaccgctggtcatattatgaaacgtgcagaaacagttcagatcgacaaaggggcacgtgttgcacttacgctcatgaaaaaccttgggatttcatctatctatgcagtcgataagaaaaagcatttattaggtgttatttctgcacaagcggcgaaaaaggcggcagaaacgaatacgtcgctcgaaactgttcttgataaagaatttacaactgtattggagtctacgtatttaacagaaatctttgatgcagtgtctgatgcggcaaatattccaattgccgttgttgatgagaaaaacagaatgaagggtattgtggtcagaggtgcattaattggtgcgttatcaggtaatgatgagtatatcaacatgtcttctaacaagcttgaggaaattaaaacacaagagccttctgcacaggaggtagaataagatgtttagtatgagtgatttacctagaattccgttcgctgattacatcgatcaatttgttgactggttaacattaacttttggtggtttctttgatgggatcacaaatggattggcaggaactgtaaatggaattgttgcagtacttggcgtggttccatctattattttgacacttatttttgcagcgctagcttggtggatcagtacaagaggaattgctcttttcacacttattggatttttgctgatcgactatttaggctactggcagccaatgcttcaaacacttgcgctcgttttaacagctgtggtcatttctatcgtgattggggttccgatcggtatttgggcatcacagaaggaaactgtgcgtaaaattgtgacacctatcttagatttaatgcagaccatgcctgcattcgtttatctattaccagcaatcttcttctttaacattggcgttgtacctggagttgtggcatccgttattttctccatgccgccaacgattcgtatgacgattctcggtattaaacaagtaccatctgatttaattgaagcaacagaagcctttggttcaacgacattccagcgtttgttcaaagttcagcttccacttgcaacaaaaaccatcttagctggtattaaccaaagtatcatgcttgctctatcaatggtcgtcatcgcggcaatggtaggtgcaccaggacttggttcagaagtatatagtgcggtaacgcagctaaaaacaggaattggttttgaagcggggattgccattgttattgtggcaattacacttgaccgtattacacaaaacatcaaaacgaaaaaaaccagggggaatgcttaatgtggaaaaagtctctctacattgggatgaccgccctgcttgtctttttactagccgcttgtggtgcaaagtcagattcaaatgcgagtgcagcacagcaggtgaataaaaccattatcggcattgatccgggttcaggaattatggcgctcacggatcaagcaaaaaaggattacggcttagaggattggacggttgtgtctgcatcaagtgcagccatgactgcaacgctcaaaaaatcttacgaccgtaaaaagccaatcatcatcactggctggaatccacactggatgttttctcgatatgatttaaaatatttagatgatccaaagaaatcttacggtgaagcggaagagattcatacgatttcacgtaaagggtttgcaaaggatcagccggatgcagccaaaatgcttggtcagtttaaatggtctcaagatgacatgggcgaagtcatgatggatatccaagatggtatcaatccaaaggatgccgccgttaaatatgtgaaaaaacataaagaccaagtagcgaaatggacaaaaggcgtgaaaaagtcgaatggtgaaaaagtcaatcttgcctacgttgcgtgggatagtgagattgcaagtaccaatgttgctgcagaagtactgcgtgagctcggatttaaagtgaccttgactcaggtggaagcaggtccaatgtggacagcaattgcaactggaagtgcggatgcctcgttatctgcttggctgccaaatacgcataaaacgtatgcagcgaagtttaaagggaaatatgatgatctaggcacaagtatgaaaggtcttcgcatgggtctagttgttccgacatatatgaagaacgtcaactcgattgaggatttgaaaaaatagccaattatgatgaagttcccttataataggagggagcatatgaaaaagcagtctgctcaagaagcggctgcttttttcttatatataaggaaggtggacgagttgtcgatgatggttaagccaatcatgatttttctgcatggcggaggagtaagcagctggatgtggcaggaacagataaaaacattcaaggaagcgtatgaatgctatacgcctgatctcattggtcacgggacaagagcagatgaacagtcatattccatgcgagaaagtgctcttgaagtcatctcgtggatcaaggagcatacgcatggacgtaaagtgatacttattggcttctctctaggtgcacaggttgccgttgaggtgttatcaaaagagcctgacatcgtagagatagccgtcatcaacagcgcacttgtgatgccgctgccatggctttacttgatggtgagacctcttttacctcttacgtatccattattaaagaaagattggtttatcgagctccaagctgaaaagatggggcttccaaacgatgtactcaatcactatgtggctgattcgaaaagtttacagaagaaaacccttctgacgatgtttcaagaaaatctccattacaagctcccaaacacgtttcaacaagcgaaggcacgaattcttgtcacagtgggagaaaaggaaaaaggtattatgaaacggtcagcaaagaaaataacgaattcacatccgcaggcagcaggtgtcatcgttccggctatcggacatacatttacgtttgaaaagaaggaactgtttatggatatggttcaatgctttatagaggaacgtgcgttaccagtggagttaaaggaaatcaagtaaccgaaagtaaagacaggcataaaagaggcagccagatcttagaaccgatatgatagaggtataaaacgcttacagatgagctgctgtctgactgaaagctcaggagacgtagaaggaggagctatgagtaaaaactatatcatattcggtgcaagtcaaggattaggggatgcttttgtgaaaggtcttccttcaagcggagatacagtttggattgtgtctcgaagtgaacctagcagtttgaaattagatgacggtgtacatagaatttggctgaaaattgatttatcaagccaatctcatattccacacatgatcgaagcattggggaacaaaaccattgatgtcctcatctacaacgtcggtttatgggaaaaacgaggctttgaagatgattattcatttgatcacgatcagccagaggatatcgctcgtttaatcaatgtgaatgtcacctcaacgattacatacatccaagcactgcttccgcatgtcaggaaatcggagaatggaaaaattatcgtggttggctcaactgcgggactcgatcatacaaacctgccgcaagtttcttttgtcgcatctaagttcggcctgcgcggaattgtgaatgcactaagagagcatgtgagaaaagataaaatatccgtcacctgtatcaatccaggagaattggcggcagaggttccatatgaagatggagccgaaaaagccatcgctctatatgatgaaacaagaattcctgtgcaggatatagtagagcttgcgagatgtgtgattcatttatcaagggtatcttgtgtaaaagaaatcaatgtcccagccatgacagatttgaatgcataatatcaagtagaccacccgctaaaaaacgggtggtttcagcgtgtagacaaaccctcgcattcgttgtcagttctgcgtgctggtgctcacgaatgtcaaattcgctccgcgccagtactcgtccttcctagaattcaaaggttttctatcacgctgaaaaggagacaaaggactaaaataaagatcattttagccctttgtcaacaatctgagaccaccctctaaaaaaacgggtggtttttttattttatgatgaatgctgctgaagagtctgataaacagcttcagtcaaaatctcaatgccggtaaaaatagcagagcggtcgaatgtcatatatggatgatgtagaccgggctttagatcacagcctaaaccaagcatcgtggatttgatatgcggaacctttgctgcataaaagtgaaaatcctctccgcctgtcgttacgagcggaggatcaagctgctctttacctaaaaccttttcaatggcatgagacatcatctggacggcttcctcattcaaggtagcggcaggcagacgatgatcagttgaaagggtaatggaagcgccaaaggcatccgctacagaatgtacggctctttcaatttctttttctagtttatccatcacttcatttgtttgtgctctgacatctagtgtaaaagaagctttgccagggatgatgtttgaactgcctccgccagcatgtaggttggtcattttcacagaatgtgcaactcttgggtcgacatggatatgtgcgagtctttgcacgagggtagaagccacttcaatgacgttgacccctagatgcgggcgtgcaccgtgggcttcctcaccaataattgtgccgatgtaatgattactcgatccatgcaagatcgcaggtgcgcagcgtccgtttaatgtttcttgaattgggcgaacatgtactccgtataagtaatcaacgtctgctagcacacctttttcaatcattttcagcgcaccgccgcctttttcctcagcaggctgaaaaatgaagcggatggtgccgtttgggagctccttttcttttaatgccatgaaggtgccgagagccattgtcatgtgtgcatcgtgaccacatgaatgattggcttgaaattccccatctacttcctgccaaagtgcatcaatgtctgctctcaccgcgaccactggtgaaccttctccaatttcaccgatcactcctgtacagtcgtcaaatgttcgggtctgacaacctattttctttaataagtcctcaagataagccgtcgtattcgtttcttcccagctgatttctgggtgagcgtgcaggtgatcaaagatgtctttcaccgtttgctgcatgtcgtttgtcaaagttgtcatgaatagcctccttgctgacagaaaatctgtcaaaatattcttttagtgaaataatattgatcttaaatatcatcagtgtttataatataacacatcatttgattattcagaaaattaagtgaaattccgatcgggacaaaggggttttgacacatgaaaacagcagcagtatcaccaccagagaaacaaaaaagaaaacttcaaatgccagatgcgtatgttctcttatttatcattgcgctcatttgtaccattgcaacatattttgtacccgcgggtgagtttgaccgaaagacatcgggggaaatcacaacagctgttcctggcagctatcaccgcattgatcaatcacccgtaagtccagtgggcttttttacagccattcaggaagggatggtagggtcttcttctattatttttctcattctatttactggcggaaccattgccattttggagaaaacaggtgccattaacggaatgattcaccatgtcatcagcagatttcaaacaaagcaattattgtttatttgtattgttggaggattattttcagtgcttggaacgaccgggattgtcgtgaactccgttataggatttattccaatcgggattattgtggcaagatccttgaaatgggatgctgtggcaggagctgcggtcatttatattggctgttatgccgggtttaacgcgaccattttgtctccatctccactggggttatctcagacaattgcagaactgccgattttttctggcattggtcttcgtgtcattatttatctttgttttcttatatctagtattgtgtacatctatttatatacaagacgcttaaagaataaagaaaagggaagtcttcttggagatgaatggtttcctgcgaagggacttggcggatctgatgcagaatctgtggacaagcctgaatttacgagcagacataagctgattttagcagtgtgtggattgtctcttgggggcttcttatatggcgcgcttcagcttggctggaccgataaggaaatggcaggagtcttcatttttatggccattgctgctggattacttggcggattagcagccaatgatattgcaaaaacgtttatcgtcggctgtcaaagccttgtttacggcgcactcattgttgggatggcacgctgcatttctgtcattttggaaaacggtaagctgcttgataccgtggtcaatggcttggcgagtatgttgacaggatttagcccaattgctggtgcgatcgggatgtatattgcgagtgcacttcttcactttttgatttcatcaggatcaggagaagcggttgtctttattccaattcttgcgccgctggctgatttaatgggcatcacaagacaggtcgctgtagaagcggttatgcttggcgaaggggtggttaactgtatcaatccgacatcaggtgtgttgatggctgtgctcgctgcaagtggtattccttatgtgaagtggcttcgttttatggtgccgcttgcgctcatttggtttgtcattggacttgtctttatttgtatcggcgtgatgatcaactggggaccttattaacatgtataaagctgctgacaatcgtttggcagcttttttcttgtggaaatatgcatggagacagcgctttgaaagcacaataagtgtgttcacaaattcgctacatatttttttgagcaacccccttgcaaaagtttgtgaagtattgcacaataagaatgtgaaatacttcacatacaaaaaacaacctagttttactcaggaggatgagataaatgacaaacgaaaaagtaaacaaagtagcacttattggagcaggttttgtaggtagcagttatgcctttacattaataaatcaagtgatcacagatgaattggttgtcatcgatttgaatcaagataaagcaatgggtgacgtcatggatttaaaccacgggaaagcatttgctccgcacccagtgaacacatggtatggagattatgaggattgtaaggatgcagacattgtatgtatctgtgctggagcgaatcaaaagccaggtgaaacgagacttgaccttgttgagaaaaatttaaatatatttaaaggcattgtagacaatgtgatgaaaagtggattcgatggtattttcttagtcgccacaaaccctgttgatattttaacatatgcgacttggaaattcagtggactgccaaaagaacgagtgattggcagtggaactacacttgatactgcaagatttagatacatgctcagtgagtactttgacgcagcggcacacaatgtgcatgcgtacatcattggagagcatggcgatacagagcttgctgtttggagtcatgcgaatatcggaagtgtaccgattacagaattaatgaagaaaaatgatcaatacaaacaagaagatttagatgagatgatggaaaatgtccgtcatgccgcttatcaaatcattgagaagaaaggcgctacttactacggcgtagcgatgagtttggcccgcataacaagagcgattctgcacaatgaaaacagtattttgactgtcagcacttacttagatggggagtacggagcagaagatgtctacattggtgtacctgcccttgtgaatcgaaatggcgcaacagaagtgatagagcttgcactgaatgatacagaaaaagaacaattcgcgcacagtgtgaatgtgttaaaagagattttggctcctcatttttaatcaaaagcaacctatctgagcagaaaaggatgaatcactatgtggcagcaaatatataatccgtttggtaatgagttcgtgagtgcattggtagcaatgcttccaattttgtttttcctacttgcattaaccgtatttaagttaaaaggtgttttagccgcttgttttaccttaatcgtcagttttgtaacagcagttttcttctttcatatgccaattgaaaaagcattatctgctgtgctgctcggtatatctaatgggctgtggccgattggatatatcgtcatcatggcggtgtggctctataaaatagctgtgaaatctggtaaattcgatgttattcgttctagtattgcaggaatttctcaagatcaacgtcttcagctcttattaattggttttagttttaacgcatttttagagggagccgctgggtttggtgtaccgattgcgattagtgccgctctcttaacagagcttgggtttaaaccgctgaaagctgcgatgctctgcttaattgccaatgctgcatctggcgcatttggtgcggtgggtatcccagtcattacaggggcgcaaatgggcaatatgacgccgcttgcattatctcaaacccttgtgtttacgattccgtttatttcattctgtattccgttcctactcattctcattgtggacggattcaaagggattaaagaaacgctccctgccttgcttgttgtgagtggaagttatgccattttacaagctgtcacaatggtgacaatgggtcctgagcttgccaatattatttcagcattagcaagtatggggattttggctttatttcttcgaaaatggcagccgaaacatatttatcgtgaagaaggagcaccagccattgaacagaaacaaacgtatcgcggcgttgaagtgctaaaagcttggtctccgttttatattttaactgccgtgattacggtatggagtctgccagcatttaaagcattgtttgctgtaggaggcccgctcaactggacaaccattttagtgaaaatgccatttttgcatcagcaaattgtgaaattaccaccaattgcacaaacagcaacacctattgatgcgatctttaaaatagatgtgatcagtgcaacgggtactgccattctgattgcagtgatgctgactggtttgtttagcagacatattacattaacagaaggcgctgcctgcttaaaagcatcagtgaaagagctttgggtaccagttctcaccatttgttttgtcatgggctttgccaacttggcgaacttcgctggtctaagttcagccattgggcttgcacttgccaaaacaggcgatttgttcccgcttgtcagcccagtgcttggctggatcggggtgtttattacaggatctgtcgtgagtaacaacgccttattcggcaaccttcaagcggtcactgcttctcaaatcggctcacaggcaggtttgttaattggagcaaatacaacgggcggggtcatggcgaaattaatctctccacaatctatcgccattgctacagcagcagttggagaaacaggtaaagaatctgagctcttccaaaagactgtgaagtacagcttcatcctgctcggcatagtgtgtatatggacattcattcttgctcaatttgtataggtttaaaaaagactgagacagctctcagtctttttttgtttatgtcgattcccttgtcacgagccgggtaggcagctggatatgctcacgctgtaatggtttttggtcttgcaggagctcaatcagttgctgcacagaccggtggccaagctctacgatcgggatgtcaattgtggtgatcgttggagctgtcacctcgcaaatgtcttgattgtcatagccgatcaccgctagatccttaggaatgtgataaccatatgaaatggcctgtttaatgagccctgctgcgacttgatcattaccggtgaaaatggcatcaggtgcattcttcatgtcatggatgacatccattaagcgaaaaccgtcttcaatggtgaaggcctccccgaacagccaatcgtcatgaagcggcaagccgtgggcagaaagagcatcgagatagccctgtttcctttgtttctgtgcttcactgctttctgtatcaaagcaaaacccgatcttttttcgccccgactgaatcaagtagtcaactgctttataggcagcttctcgctcatcgtatccaataatcggaatgtctgctgtttgatgatattcattcgccatgacaatagggccgttcgttaaaaatggctcgatcttttcccacggattttctaatgcccctaaaatgaccccatctacttctcttctttttaataattgaagaccttcaagctctaacgactcctgataaaacgtctgaagcacgatcgctttataaccttgatccagtgcttcttttgaaatgcctttaatcaattgtgcaaaaaaaggatggtccacagccggcacagacacagcaatggtttttgtctgatgtgaacgtagagtgcgagctgctgaactcggtgtatattccatttctttcatcacctgtaaaatgagctggcgcttttcctctgacacatatggatgatgattcagcactctggaaacggtggtggttgaaaccccgcagcgtttggcaatttcataaattgtacacatattaacaaatcctttacacaaagttattgttctgaaatcgataacatcatttacaatgtgaaacaagttaaatattaacaaatggaattgattaattggagggaatggaatgcaaatattgacgaagatatcaggtaaaagcaaggattatctccctttgctggatatgatcaatcaaggtgttcaagtaaagtctgattcagttgagaagcacctagcaaatgaaaagctggtgacgttcctcgaacaagatataaggcgcactggcttggaaaaaattctcttccattataaacaaaataaggaaaaaaagataccgtttctgccagtcgataaactgatttcagaggatgagatcgatgacattatgcaggtactgaaagaagtattgagttccggccgttttacttcaggaccatatattccggcgtttgaaaagcagctcgctgagtacttagggaagaaatatgtcattgccacgtcaagtggaacagacgccctaatgatcagtctcatatcagcaggagtccatccaggagatgaggtcattttgccagcaaatagctttgctgcaacagaaaatgcagtgcttgcgattggggctgttccggtctacgccgatattgatccagatacttactgcttggcaccgagtgaaatagagaagcatatcacagatcaaacggcatgcattcttccggttcatttatatggaaaacaagcggatatgaaggccatttcggcgattgcgaaaaagcatgggctgaaaatcattgaagatggctgtcaggcaatcgggagcactggcctcggagcatatggagatgggcttgttctcagctttaatccatacaaaaatcttggtgtctgcggtaaggcaggagccattgcaacaaatgatgaagccctagcggagaaatgcatggagatcagctatcacggctttgaagtaggaaagaaaaatgtcaaacgcagtgactatggctttaattcgaaaattgataatttgcaggcagcgatcggactcgaacgtatgaagtatttaggattacaaaactttaaacgtttctacttagcaaagcgctacattgaccagctgcaaacgctagaggatgaaggatacttgaagcttccgaagctgacggatgatcatgtctggcatctgttcccgatcagggtgctgaagggagaacgagatgagcttgcagcgaaattgctggaaatgggcatagagacagatgtttattacccaatcctatcgcatcagcatcaaacagatcttgtttctcaaaagtataaacgtacatcacttccacatacggaaaaagcagcacagcaattacttcacttgccgctgtatccaggcatgccgctgcaagatcaggagaaggtcatcgagggggttcaacatgttatcaagtcttccattcaataaaaaactactgaatcagccgaaaaatccgaagtggatcgtcttctgtgattttgatgaaacctattattctcacgaaatgacagaggagcagcgagaggatgtcaagcggctggaggcctttgtggcagaaaagagcgaagcaggagagcttatgcttggctgggtgacgggaagtagccttgattctgtgacaagcaaaatggaaaaaggcggttttcatcaattcccacatttcattgcatcgaacttagggactgagattgtgtatacatcagatgctcattttggacagccagatgcggagtggatgaagcgtctggatgcacagggcttttcagatgaaaaaattgaagacatcctcgaaaccatacgtgaaaagggaattcatctcagaccgcaaacgcagctgggcagctcagggtataagaagaatttctattatcaggagcaggatgagcggacagatcttcatcatctatcattcatccaaacacttgccaaagagcgcggggtggcggtcaacatcaacaaatgcaatccgctcgcaggagaccctgcggattgctatgatgtcgattttttaccagtcggcacagggaaggatgaaattgtccgctttatgctgaaacaatatgatttatcgaaaggtcaaggctttgcctttggagatagtgggaacgatttgcggatgcttcaatccgtcacgcacggtttcctcgtccaaaatgcgacggccgaagccaagcggcaccatcatcaaatttgtcatcatgggtatgcaaaaggaatctatgaaacactgaaaacagtgatgtataaacatgaggaggcacattcatgaagaaaattggaattgttggagcagggaatattgcaaaagcacatgcaagagcattgtcaacgatcaaaggtgcagagttatcaggtgtctatgatttacacgagtcagttgcacagggattcattaaacagtatggcggacgtgtgtattcaagtatcgaaactttagcagatgcatctgatgggttgatcattgcttccccgaatttttgtcacaaagaccatgcccttcaagcactaagagcaggacagcccattttatgtgaaaagccgatggctgtgtcgctgaaggaagcgaaggaaatggtggagacagccaaacagttccaggttcaagccagtatgggctttaactatcgttacttatcctttgtgaatattttgaagaacttgattgccaatggtgaattaggccggattttaactgtcaggactcattttaagaaaaacagtgccctcagaagaaagacattttcatggagagacagcggggagagtctgcgtacgagcggtgcattaggagatcttggcattcatttaattgatatgctttggtacttatttggcagtgacatgaagaaagactccttaaataccaagatgctgacgcatgtaaaggaaaaggaagagaaaaaggtacaggtggatgatcataccgaaattttcggtcagatggagaatcaagtgttctttcatttggtcacatccaaaagcacgcagccggaggaatgcggatttagtgtagaagtcgttggtcatgacaaggtattcaaatatcatacgaacatgaaaaacgaatatgagatcagcgatggcttgtgtgtggagcgtcatcaaatgccgcaaaccctgctgacagatccgccaaatgaattttacggatggtctgatacgttccgtgatcagctgatgcactgggtgaatacagatccatatccatctcatatgaaagttgctgattttgtagacgggtatcgcgcacaggctgcgcttaatacatgcttcgagagggaagaggctgtcgagtctgctcgggcatattaaagaggtggagcggaggatgtcaaaactccgctcctttttagaggaagtgaaaagatgaaaaaagtattttattttggctgtgtcttttatttttttattgggaccattcatgtgttttttggcagtttaactccttatttactgtctagttacgataagggtccaggggaattatcatctttaattttttttcagtttattggttttttgacaggggttctgttatcccccatccttgtgaggaaaaaaggctatggcgctgttctgactatgggtcttttgctgatgattgggtcacttctgcttgggcttttggtgccgggctggtcaacacttgtgcttgcaggtttttttcttgggagtggtgcaggcagtcttgagacaacggccggagcgtatgtgatttcgatggcaaacagtgcaaagcgaatcagcatcatggaggtcttctttgggttaggagcgctgttatttccacttgtgattttactgactgtcaatgaacagacgtggcactatgtgtttttatttcaagtcggtgcactgactttcttccttatgctctggcttgcctttatgaacaaattgcctcgtggacagatgacttctccttccaatgggggaagaaaaccgtccttacttgttgatcgaaacaatcgaatcattgtggtaatcatgatttgctttgcctttttctacgcagggattgaaacgaactttgcgaactttttgccgtcgatcatgctggagaaggggggagacaattggggtctctttgcagtctccactttctggacagccattgtcatcggcagaaccgtgattgcgagaaaagcagaccagctgcacccgctgcgttttttaaagctaagcgcagcactcatgattctgctgctcgtggtctttgctttgaccacccacattgccgctcagctgctcctcatctttttcattggcttgtgcgcagctggtatgttcccaatcgcactgactgcatctgcattaatgattgaaaatgccatcgacgaggccacgagttactttattgcagccgcaagtttaggcggagcctgtttgtccttcttgatcggctttagtcttgaatgggcaggagcagcaagtgccatctttgttttcgccttcttagctgttcttctatttgcagctgcgattcaaatgaatcgtatgaagaaaaaagaaaccgttctcccgcagcagtcggcactgaaagcggatcgataagcgatatcaatgcccttgagtccgcctgaaaagatgacaaaggacttgtactaaaccatagaacgtttgaataatatgtacaagtcagcatcaaaaggaggacgtctatgtggcggtgttttttgggtatatctttttagggttgtcactttcagcgcctgttgggccagtgaatgctgcccaaattgatagagggattaaaagtggcttttggcatgcgtggatttttggtgtgggggcaatggctgcggatattgtctacatgctcctcatctattttggtgtcgcccagcttttgactgcacctcttgtgaaaacctttttgtggctgttcggttttttcgttctaacctataccggaattgaaagccttcgtaaaatcaacttgcaggaaagtccaaagaaggatggaggaaacacgtcgatcgggcattcgttcatgacgggatttttcatttctctttccaatccgctcagtattttattttggcttgggatctacggcagtattttggccaatacgatcgaaaagtatggggcatctcaaatgctgatgtacagcatagctatttttatcggcatgttaatctgggatttcagcatggcgctgttggctagttcgtttaggcgctatttaagtgaacgtgtcttacatggcttatccgttcttgcaggcttatctttacttggtttcggcgtctattttgggtatcaagggatcatggcgttgatcgggtagaaaagcagactgacatgtcagtctgctttttttgtaaggattgacagacataacacattcttgaataatggtgagatataaaatggattcaaggagctttgccatgcgtatttttcttccagtcttcaactatttgtgcatgctgatcttatcagtcatcacagcaacattcgtatataccctgctatttatcccgcctgaagcaggctttggttatgtggagatgacaagtctgctcattttgattgcttatgtagtgtttgctacaccgattcagcttgttttacacaggcatcctagaaagtttcgaggccgtgacttacttgtttattttcttgcggcgtgggtgatttgctctgcgttagcgttatggattgattatggactggttgtgttcattagctacaaagtctatctgttttgcttttgctcagccctcatttattgggtgctcgattctgtctttttaatgaagaaccgatcatagggttgatacaaaagtgctctatgaaaagaagcagcatggcgtgaaaggcacacatacatgctcaatttgaacgagaacatccacctcttgaatgcgcaatgaaagtcgcttagggacagtcaccacagcctttttttctcataggctatggagaagacgctaaaacgaggtggaaggaaatggcccagttgtatgcaaaaagttgccttgatcaaaatctacgatcactagaagaatggaagcaggatgcttttacgctatttggagagatggtaggagatgaggcagatacattcccttgtgtccccggaagacagggattttttctcgatcatttacgctatgggtttgtgggtgatccgagggaagaggaggctgttgaggaattagcgcagctgctgagagaatatcaaagctgtgcgaaagaaacgggtcaatatgcttcatttatttgtttttttgaaacaccacaggatttaaaggaaagttcgattgaagagtttgagcagcagttttggtcattgcttcaacgactgcaccagaaagatgaagtgccatggcctgaggagattccactagatgctcatcatcatgagtgggagtattgctttcacggggaagcatattttattttatgctccacaccggctcataagctcagaaaaagccgccacttcccttatgtcttaatggcatttcagcctagatgggtgtttgataaattgaatggatcgaccaagtttggtcaaaaaatgagccagctcgttcgcaagcggctcaaagcgtatgatgaggtcggtgttcacccatcattaaaatggtatggtgatccgatcaatcatgaatggaagcaatactttctcccagatgaagaggcggagaaaccagcctccgccaaatgtccttttactgcattaagaaacatgatgaaattatgatgcggtctgatcttgctgcttccactttttcctcataaatagcaccatgatggcaatcactgcaatgatcccaaggctgataaaaaagccaggtcgtccgcttgcctctgttaaagtgcctgaaatggcggctccaatcaagagaagcgcaagaaacatttcgcacgtttggcgagtggatggctttgatagttttttacttgagaacagaatgaagacccatgtgtacagaagggtaagaccggctgctgttgtgagatgctcgtagatgtgtttggacaaaaagagtgcaagcaaaatcgagacaattaatccagcagcagttaaaataatcgaaggccatccgacatgagaagggtctttttgtttaaaacaagcaggtgcatcttgatgctccgacatcgtgccaagcagcgtcgtgactgcatagagtgaggcaaccaatgtcgaaaagccggcaataatgaaaatgccattaaagatatgaagaaagatcgataaatgaaatggatctaatgatgtaataaatggactgctgttctcgttaaaggctgttactgggacaagcaagagagcaagtccgatcgagacgatatagatgaccgctagaatcatcagcatgacccgtccagactttgctgcatccttcgggtcttttaaatgaaccgccatcagccccatgacctcaattcccccaaatgcataaaacgcgtaaatcaatccattccaaagaccaagtgcaccgagcggcatccattcgtgatctttgtttggcagatgcagggtcggtttatgatctgtcagaatgccgaataacaccagaactgccaggatcataaatagaaaaatcgccgctgtcttcagtactgctaggacattttctgtcttttgaaaagaagagagccctatgattatcacgagcagggcaagagcggaataaatggcagaaaacacccagagcggcacagatggaaaccagtggcgggtaaaaagagaaatcgctgttaactggcttcccgtaatcagcatttctgcaaaccaatacacccagccattgctaaaccctgcccagcgtccatatgctttacgagcataggagcaaaacgaccctttatcagggttatcagctgtcatcgcagccaaatgtttaaagacgagataggttccaaccgcagcaagtaaaaaagaaatgcagacggaaaaacctgactttgtaatggcaatgctggaaccaaggaagaaaccagtgccaatcgtacagccgactccgatgagagaaagctgccaccaagataaagtttgttcttctttcaatgcatgcgcaacacctttctgtttcaatgacattagcttgtgaccgcctcttttttttatacatgatcaagaaagaggacgttttgggcatactgtcaaggaaaggagtgcatgtgatgaacggagaacatgtcattttaccaaagggcagactcggctttcgtttaggaaaaggccaatgtatgcgggtggttgatgttgaaggtcagcaagtagcagatgtgatggcttatcacgaaaaggatttttatgaaaaatttgaccaaggcgcgacaatggacagcctattttcatcaaaagtgaaaaaaggcgataaactctattctaacttatacaaaccgatgtttacgatcattgaagactcagtcgaatgccatgatttatacatgcccgcctgccggcaagaaatgtatcagcttttatatggacggacgcatttagaggtcatgcatacatgctacgataatttgcggaatgcctttaaaccatttgggattccgaaggaggatatgtactacccttttaatgcctttatgaatacagtcattgatgaaaaaggaaagctgtctgtggagctgccaaaatctcttcccggtgattatattcgtctgcgagccgaaatggatctcattgtggccgtatccgcatgtcctgctgatattgggaagtgtaatggtgcaaactgtacatcgatacgggtagaaattgattgaaaaagaaaagggccagtccatatagacatggtctttttcatttatgaatgtttgatcatgaatgaaataggggaacgtctaacaaaatgttcttcctgaaaacatggtataatgaagattcaaaaaacgttgtcaaatcaatgaattcagagtaaaacctgttctcttcatgtagaggatgcttaggaggaaaagtgtatgagtttgcaaaaaaagatcagccaagagttgcatgtgcagccctcaattgacccaaagcaggagattgaaaaacgggttggatttctaaaggactacttgaaaaaaaccggtgcgaaaggattcgttctcggcattagcggcggacaggattcaacgctcgctggccgtcttgcacagctcgctgcatctgaactgcgtcaagaaggaaaagaagacgcagtctttattgcggtgcgtctcccgcatggtgtgcagcaggatgaagatgatgcacagctcgctttatcatttattcagccggacaagtcgtggaaatatgatattgcgcctgctgtgaaggcattcagtgaacaatatcaaaaagacatgggcggaccgttgtctgactttaataaagggaatgttaaagcgcgcatgagaatgatcgcacagtatgctgtcggaggagaagaagggttacttgtcattggtacagatcatgcagccgaagcagtcactggattcttcacgaagtatggtgacggcggtgcagacgttctcccgctcacaggtctgacgaaacgccaaggccggatgctgctagaagcgctgcaagcaccagagcgcctatacttaaagaaaccaacagccgatctgcttgatgataaacctcagcaaacggatgaaacagaactaggcattacgtacaatgaaattgatgattacttagaaggtaagcccgtgtcagaacaagcagcagaagcgattgaaaagcgctatgttcaatcagagcataaacgccaagtacccgcttccatgtttgatgactggtggaaataaaaaaaagacctctccagaagatggagaggtctttttatgtcgaatttcaaatgggtttgacaaaataaccaaaaattcattaaattagtagaacgatatacttaagtctaattcactaaatatagatttatttgaaaggaaaatgcattcatcattagttcgattcacttaatttcactgccattgacagtattttcagaaaaaatgattgacgaagaaaaagaatgcgcttacaatgaaaacacattccgaaaagtgaaattagattccactgtatggaataaaggggtggttcactccaaataagaagctaaaggaatgattgacacaatgaaaaatcgaagtgcactggaaatttacaaagagggaggcgcttggtgggaaactgagattagtcatattcaaaaaaactcaattgaacttcgaggttatccgattgaagaactgattggtgaactgtcgtatccacaaatgctttatttactgcttgtaggtgaattattggatgattcaaaagcagctctttttgaaagtgttcttgtcgcaggtgcggaccatggaccaagagcgccatctattgcagcagccagaatggcggtgacttgcggcatttcgtttaattcatctgttgcaacaggggtgaatctattaggtgatattcatggcggagccggtgagaaggccatgcgtatgttatacgaagccaaagcgatctacgatgatcaaaaggatatacagtctgcggccaagcaagtatgtcacacatggttaactcgcaaggaaaaaattccgggaatcggccatcagcttcatgatgatgatccgagggtgagacgtctatatgagctgagtcacacatatgtccagcaaggtcttatcagtgggatatatttacggttagccgaagcgattagacatgagcttgaacacctgaaagggaagaaaatcacgatgaatatagatggtgtatctgctgccatccaatgtgaattaaacattccagcagaagcagcaaaaggcattttttccttatccagaggaatgggcatcgtggcgcatgcatatgaggagctgacaaagggagccctcgtgaaaggaccttgtccgaatgaagaaagattggttcgttatgcaggacatggaacgcggcacttgaaggagggagagaaaatttgagctatttgaaagcgttatcatatataaacggcgagtggctggataccggtcgtgtgaaaacagatatcacaaatccttactcaggagaaaggataggtacatcatatctcgcctcaccaaaagacatagaacaagcactttctattgcgcagcaggctaaaaaacaaatagcgggaatatcggcaattgaacgctcaaagattctaacaaaagcaaccgccttgcttgaagaacaaaaagagcattttgcaaaactgatttcgttagaattaggcaaaccgcttaaaaatacaagagatgaagtctcacgatcaattgagacgctggcgcaatcggcggaagaagcgaatcgattaataggtgagaccattcctggcaatgtatcatcgcgtggacagggagcaatggccatgacatttaaagtaccagtcggagttgtgctggcgattactccttttaatgcacctctcaatttaatttgtcacaaagttggcccggcttttgcgggagggaatgtcattattttgaagcctgcaccgcaaacttcagctgttgctacagcgtttgtcaaactccttctcgaagcagggtttcctgaggtaagtttgcagcttgtgattggcggggtcgacgcggggaaacagttagttattgatgaaagaacaaatctcatctcttttaccggcggggctgccggaggagaacatattacaacttctgcgggattaaaaaaagtattgctcgaactcggagggaatggcgcgacgattgttcatcacgatgctgatattgaacaagccgcatccctttgtgccaagacaggctttagtaattctggtcaaagctgtatttctgtccaaagaatttatgtccaccaggaaattatgccgtcgtttactgaggtattaaaacaaaaagtagatcagcttgtcgttggagatccgttgtccagtgagagtgatatcggctgtatggtcgatgtacaggccgcgcagcgagttgaggcatggatacaagaggcagagagtatgggggcaaagcttttatgtgggggaaaaagaaatggagcgagcatcacaccggctattttgctaaaccctccgaaacaggccaaggtcgtctgtgaggaagtgtttggcccagttgtcagcattctcccttatgcggagctggaagaggcaattaaagaagcaaatgatagtcgatatggtttgcaggcagggatctttacgaatcagctggatgtggcgttacacgcagcaaaagagcttgaaactggcggggttgtcatcaatgggacatcgaattttagactggatcattggccttatggtgggattaagcgaagcggtcttggaagagaaggtccgcgtttcgccatcgaggagatgaccgaaaccaaaatggtcgtgcttccacagggtctgtgaaaggggcgtttggatgtgaatgcatttcagcaaaaggtaaaaagtgtgcagacaggcgctcagccaatgatttgtacgccgctcatcggacaaacaaaggaagaattgtttcatgaggtcgaggtattaactgagaaaaagccagatgtgatagagtggcgggcggatttttttcatcaccttcatgacaaggaacaagtgatagaaacccttaagggaatggtagaaagggcaaagggcatcccatttttattcaccattcgttctgaaaaggagggcggcgaaagtatatcactctcggaatctgagaaggtttctttgcttgccgagctttgttccactcagcttgtggacgccgttgattatgaattgatgcatgatgtgacatatatacagcaagtcagtcaggcggctaaaagaaatggggttaccttgattgtgtcgtatcacgatttccagcgtacccctgaggtagatcgtctcatgcagctattcgtcaatgcagaatcagccggcgccgacatcgcaaagatcgcagtgatgccgcattcctatgacgatgcattaacactgctctcagcgaccagccatgcgaaaaagcagctgtcaattcccgttatttcgatggcaatgggggaatacggggcttttacaagaatgattggcggactttttggatctgtcatgacctttgctgtagggaaagaaagctcagctcccgggcaagtggcgatacaggatttgaacaccgttctatctattgtttttcaaagaataagtgagtagcagattcatagctgcaccgtgagaggagagaaacatgaagaagaatatttctacacaggttattcagtacttagaaaatcggggagtcgagcatatttttggtctctgcggtcatacgaatattgcctttttatcagcgcttgaaaaaagctcgattcaatttgtaaatgtcaggcatgaacagatagcggcacatgcagcagatggttatgcgcgagcaaagaaacagacggctgttgtgctcagtcatctaggtcctggactcaccaatgcggcaacaggggtagcgaatgcagcacttgattccattccaatggttgttattgcaggcgatgtcccaagtcattactacggaaagcacccacatcaagagatcaatcttcattccgatgcctctcaatacgaaatttaccggccgtttgtgaaaagagcatggagagtcgatattccagcattatttccagagattttatcaaaagcatttcagttagctgaaagcggccgtcctggtccagtgctgatatctgttccaatggatgtgttctcaaaggacctagatgtgtccttgtttgaacaaatcaaccatcatacacagaccattgaaaaaccttcaattgatgatcaaacagccaatcggatattagatcgattgctgcaggcagaaaaaccgctcttatatgtagggggaggcattttactagctgatgcagctgaagaattaaaggcattttctgaccatctcagtatccctgtcgcccattctttgatggggaaaggagccatgccggatgatcacccaatgacccttggaatgacaggattttgggggacaaaatttatcaatgatcagtgcaaagcggcggactatatattggctttaggcacccgttttgctgaagctgatgcgagttcatgggaatcagattatacgttccgtttcccgtcaaccaagctcattcatattgacattgatccgaatgaaattggacgtaactatcctgttgacattggagcagtagccgatcttaagcaggccttgattgtactcaatcgagtggcgagagaaagattgccagaagggctgaatcgacctgaattgaaaaaggaaattgcggcatatcgtaaggattttcaggcgggcaacctgacgaacactcaagatgaatctttcccaatgaagccgcagcgtattttgcaggaagtgcgggaagtattgccgccagatgcctttattacaacggatgttggctggaataaaaatggcgtaggacagcaatttcctgtgctcacgccagggaccattctaactccgggaggctttgcaacgatgggatttggagcccctgctgcgcttggggcaaagattgcccagcctgaccgtgtcgttgtgtcactcgttggggacggcggattcggtcaaaatccatctgttctcgcaacagccgttgaagagaacattcctgttgtgtggattgtaatgaataacagtgcatttggaacaatagccggcttgcaaatggcgcactatgaaacgacgtacggtacagttttcagaaaaggtggagaaagctattctccggattttgcagccattgcaagaggttatggaatgaaggggattaaaatcacctctgcttctgaattcaaagaagctttagctgaagccattgcatctcaagagccttgcgtcatcgatgtagcaatgaaaaatgatcctgtccctacggatggacattggaatattaatgatatttattcaccaaattcaaagcgctcacatgtcagcgtgaattaaacataacgaggaggaatgaacaatgaaaattaaagtattaaatccgtttcaagatgggaacccattatggttaggtttagatcatccagaggagcaaatgattcggaaggtatttcaaaccattacaccagatactgttgggtcagagcatatgatggcgggtctcaccatttttgaaccgggagaagcaagttcagtgcacaatcacccgggttcagaggaatttgattatgtgattaaaggatctggtgaagtcatttgtgatggagaaaggcagtcctttaaacaaaatgatttcatgttcattccagatggtgtctcgcatcagcatgtaaatacaggagatgaacctttatggctcatttggctttacacaccgcaagggcagcttccgaaggattaaaaaaactgcaccggtaagccctccttttgaactatcagggccttccgagtcaatcagaaagatgaaaagggctaaaatagaaagttatttagcccttcatcatttgaatgaaagggagtcaagcaatgaatatgaatacaccgctcgaaggaatgaaaatattagacgtctctacgatgatcgctgcaccctatggcgcggtgcttctaggggattttggtgcagaggtcatcaaagtcgagattcctggtaaaggcgatacgctgcggcatgttggcccttttgcagaaggcgaaccacttagatggtcaggtctctcacggaataagaaatctctcacactcgatctgcacaaagacgaagcaaaagacatttttaaaaagcttgcaggtcaggtcgatgtgttgattgaaaatttccgccctggaacactcgaaaaatggggcgtaggatacgatgtattaaaagaaatcaaccctcaattaattatgattcgtgtttcgggttatggacaaacgggcccgtttaaggacaaggccggatttggaacacctgcgacggcgtttagcggctttacatatattcaagggtttccagaccggcatccagtcagtccttccttttctttaactgattatattgcaggcatatatgtggcgtttgctaccgtgacagcgatgtattacagagatacacatccagaaggaactgggcaaatggtggatttggccctctatgaatctgtgtttcgtatgttagaatttttggttgcagaatatgacaagcttgggaaggtgcgtgagcgttcaccggggctaagcggtcattcaagccctgccggcacctatgagacaaaggatgggcactatttggttcttgtgacgagtaccgattcgaccttcaatcgattggcagaggcgatgaatcgattagatttattagagaatgaaaaattcgcggtcaatgcatctaggctgaagcataacaaagagatggatgcgatcgtctctcaatggatcgcgtcgaaaacaagggatgacgtattagaaattctagatactcatggcgttcctgtgagcccaattttaagtattcaggatatttttgagcatccgcaatttaaagcacgagagaatatcgtcgaggtacatcatcctcgtcttggaaaagtaaaggtgcctgggatcattccaaagtttgaaaaaacacccggaagtatccgtcacattgcacctgatttaggcgaacataattttgagattttaacaaatatgcttggcttaacagaagaagagtgcaaacgattggaagaaaaaggggttatttaaggcgctcaaccgaaccgcacgctgcggaaacaaaggaggatggttatgaaagtgcattcagaactgaaggggaatgaattgcagcccgcttatatgaagccaacgaaagcccgttttggcatattgattctgttgttttttattaccgccattaattatattgatcgagccagtgtatccattgttgcacctgctattcaatcttcattgcaattaaatcctgccttattaggcctgatcttttcagcatttagctggacatatacagcgatgcaaataccaggcggctttattctcgataaatttggctcaaaggtaacgtatgggatatcactcattacttggtctattttcacaggcctgcaggcgtttgcgaacagctttgcctttttattcggctgtcgtttgtttattgggattacagaatctcccgcatttcctgcgaataaccgcattgtcaccacatggtttccaaggcgggaacgggcttttgcaacaggtgtttatactgctggagagtatgtgggtcttgcatttgcgacacctcttcttttttggatcatgacgactttcgattggagaaccgtctttattacagcaggtgcgctcggtattatatttgctttcttttggtacaagtattatcacgaaccgaaagagcatccaaaggtgaatgaagatgagttagaattcatccggcaaggcgaagggctgacagtcgcatcacaggagaaactgaaatgggcagactttgccgcccttctaaaatatcgtaaattgattgggctctatattggtcaattctctgttgcgtctacactttttttctttttaacatggtttccgacctatttagcagaggcgaaaaatatggcgtttcttaaggtaggttttgctgcttctcttccttatattgctgcattctttggggtcttgtttggaggttatgtgtctgactggctgcttaaaaagggcgtatcagtgaatgtagcgaggaagctgccggtagtggttggcttgcttctgacgagtaccattgttttagcaaactttacaacgaatatcccgcttgtgctgaccattttatccatcgcttcatttgcacaaggactgtctaatatctcttggacgatgctgtctgaagtggcaccaagggaaatggttgggctggctggcggtgtatttaatttttttgctaatttatctgggatcatcactccgcttattatcggattcatcgtgtcggcgacaggctcttacaacggggggattttattcgtcagtttagtcgcattaggaggggcattgtcgtacatttttatcgtagggaaaatagaacgtattcaattaaaaccagagtgagaaagcaaaagagaactcaaaccaaggtgagttctcttttttatgaataaaaaagaacggtgatgatcgttgcacatgcgatacccatgctgatataaaagccagcaaaccatatattccagcgtgtgatacggtaagggttgaccttcatcaaatcagctaacagggagacagaaacattaaaaggactaaacatgacagttgatgttccagcaacgatcagcatgatggcaataggaagagcaggcagttcttggatgacaggtgccatcatgctgactaacaaagcaagcgaaacgagcgggtgaaaaccgcaaagagcggtgatcagaaaatataacccaatgacacaataaaccaaaatggtatggtctgatatactgacaataaatgcttgaatcggctgcatactgtttgtggcaagcagcatatcgacaaagaagccagcacttaaaaatagacacatatagttggagagctgacgggttctttctttccaatgagggacagagacggctatatattgttttctttttttgatgacagaagagaataatagagcaaatggaataatggtcagcacaacagcgaataaatagcctttcccaatccatgcatcgacaagtgagacggctgtcataaaactcagcagcatgaaagcaagctgaagggtttttcgcttaattcgacgaggattggagtttgtttctgcggactgaatgatgtttgggaatcgtttgctttgacgagaaaagagcagccaatctgtcgccagcacgatgaccattaaaccaaaagtaacaggtgcaatttgataatatttgagtttggttgcatcaatggtgacgcttacgagcacttcaacaggactccagcttaaacataatgcatatgaccttaaaaggttgcgtgtataaagatgttgtttcacttgttcttttagggattcgagcgacggtttgagcgatgtatatagtaagggaatcgtcgcgatatttaaaaacatgccaagaatatgagtgacaaatgaactcttgcgatatagctggtttgtgtttgttgtatgtagtgtaagcagtttatttaattgtgtatcgaaatgtccaacatgtatgagagaatgaataaaaggcagcatgaaaaatagagaaagcaagcctagcatggaatgaaagtgaagaaaaaaagtgtgcaatggctggtcggataaaaagaataagaacaagccaatcatgagaaacataccacctgttttcaaataaagcccacttgctttcttaaaagaaatggtgagcgaagcagcagccagcagaccaacaaaataggagagtatggcagcgggaaatagctgatgaacaatagataagctaatcagaagtgtaaaaacgagcaggtacattcaaatgccacctccatcaaatcttcaattgattttattccgtctgacggaatttgttttctcatagtggaacgtttaaaatggattatagcaaaatcgatcgtttatgtcgataagaaatcaaaggggaaaaggagaaagtgaacatggctgataagaagtcaaaagaagaatcaggactgcgtacggttcagcgcgctttggatattctttattgttttagtgaagaacggcaagagctgacgctaacggatatttcaaaagagatgaatttagcaatgtctactacaacgagactgctcaaagcacttgaaatgaatcattttgtggaaaagaatccagacacaatgaaatataggttgggtcaaagactttatctccttggatacattgcggggaagtccattaaattgagagaactggctaaaccactcatgtacgcacttcgtgatgaaacaaaagaaaccgtcaacctgtatgtactggatgcaacaagcagggtttgtattgaacaagcggaagggctgcaatcgattcggcatcttgtcaaaattggtgagaagctgccattgtacgcaggtgcaggcggaaaggtattattggcatttcaaagtgaagaatttcaacaaaaagtattagcgtctgaggctgatcatgtgatgagagatgactggcaaaaggaatgtaaacatattcttgacacgtatacttcttgcagcatcgatgaacgagaggtaggctctgcggcagtagcggcaccagtctttaacattcatggggaagtgaaggcttgtttatccatatctggtccaacccaccggtttactgaagaagtcattcccaagctgcagcaaaaagtgaaagaacaggcacagaggctttctgaacagctcggctacgtcgtcaaacacaatttttaagattgcctatcttttcccgctctttttatcatataatagaaacattatgtagcattccttgtcgtaaggaggacgtgtcacgatcatgaaaatcaatagagaaatccctgtaagacagcggaatattgttctcattggctttatgggtgttgggaaaacaaccattggtcagctagttgccaaaaagctatatcgagattttattgatgtcgatcaggagattgagaaaaaatacaacatgacgattccagagatgtttcagcaaaaaggagaagcattctttagacaggctgaaaaggattatatcgtcgatttatgcgaacatacacagcttaagatcgtctcacttggaggcggtgcattcaaacaggaagaaatcaaacgtgcctgcttgaagcattgtacggttcttttccttgacctttcttgggagaattggaagcagcggcttgatattttaattgaaaaccgtcctgttcttcacaaccggtcgcttgatgaaatgaaagagttgtttgaagaacgccgtgagatatattctcttcataactccagagtggaaacagatcatttagaggctgaggaagtcgccaattatattgtggacacactcaagcttggctgggatttatattcgaaataaaaaaagtctaccgtttagggtagacttttttctattgatgcctttttcttcgtagataggatgatgttttgacagtaaaatttatttatcctttttttggtgtgtgactgtttggaaaaagtgatcatacatcatcaaccaaatcatgatgatgaggttttttggttgatatagtaaacaaaatatatccctcattttcttttttggaaaaataaaatagtatctaaaattcaataatagtattttgaattattataatttttaaaaaataatgttgacaccctcggcgatatcattctatgattgtttacgtaaacgcttaccgtaaacgtttactataacgagtggggaggaatttgtttatgaaaaataaagaaaaatggagcggtgtattcccggctgtcttaattccttttaaagatgactattcaattgatgaacctgcttttcgtaagcttgtccgttgggtggcggatcacaaagggattaacgggatcgttgtcaatggacatactggcgagattatgactttactgccacatgaacgagctgaagcagtgcgcattgcagccgacgaattaaaaggggaagtacctgtcatttctggggtttctgcagaagggacaattgaagcgatccagcatgcaaaagccgttgaagaagctggtggtgaaggtatacttctcatgccgccacattcatggctaagattcggtatgcagcctgaatcacctgtccaattctttaaagatgttgcagaagcgattgatatttcaatcattgtccatcaatatccaacatgtacaaaaacctcatatacaaccagtcaattactagaaatgtcggaaattgagaatgttgtttcgtttaaaattggtcaaagagacatggcacaatacgaggtcgatgtacgggcattgaaaaaacatgcaccagatgtatcgttactcacatgtcatgatgaatatttattgccaacattggttcaaggcattgatggagcacttgtaggtttcggctgtttcgtgccagatttgatcgctgaacttgtgaaatgtgtggaagaaaaagaccttgtagcggctaataaagtttacgatagaatctttgaattaaagcatgctgtgtataaaatggatgaaccttcatctacttctcatctgcgcatgaaagaagcgatgtatcagcgaggtttgatcagcagctcgcttgctaggaagccggtattacctttaactgatgaggaaaaagaagaaattcgccagggccttcaaagtgttggtttgcttaaggaaaacgtcggtagataacagaccattgatttcatgatgaaggtgagtcaggttataatagtgtataaaacaacagactcccggaggtatgaaatgtgtcagtaagtattaaagatgtcgcattgaaagctggagtgtctatcgcctctgtttcccgagtattaagtggtaaaccaggagtaggtgctcaaacggctgaaagaatcaaacaagtgattgatgagttaggctatcgtcctaatctaggagccagagggctcgttaaaagaaagactgggaatatagcggtcgtggttccgcgtggctcatatattttgaataatccatttttttcgacgattttagatggtatagcgaaagagttagatgaaactgaattcaatatgttgatgtcatttacatctatacagcagcagcgattacttgaaacgcaagctgtagatggtgcgattttattttcgccaagaaatgaagaattgagcatggattggttaaaaagtttagcgattcccattattgttgttggaagttacttagaggattctcctttcccatgtgtcagaccagatgatgaagaaggtgtgtgtcaatctgtaacggccttatttgagaaaggtcatcgaaccattgggctggtcaatggtccaatgagttcgatgcatagtgtcaggtattacaatggatatgagcgaacacttaaaaatttagggttaacaatgaacaaagaacttgtgtttgagttagatgaatttgatgggggaaaagtagtagaagtggtttctcaatttctccaaggaaaccagcacatgactggagttgtttgctcttcagattttttggcgatgggggtcatgaaagctgcagatcacgcaaatgtgtctatacctcatgacttgtctgtcgttggtgccgatgatgtgcccattgcaagctttctaaccccttctttatcttcagttcatgttgatttagttggcatggggagaaaagctgtttctttattaacacaggtattagatggagatctgatagaggaaatggagcatatcttccctatgtactatatagatcggggcaccacgggaacgccaaaaaagaaatgatagatgctgaaaactcgtatgaacgctttagaatgtctcttgatttgaaatgtaagcgatttctttagcgctcttcggcatgtacttttgcatcatttcctctaataaggaggagatatcatgacgttagaagtcagcggaaattcaaattctcatgatgggcaagttgttgatagagcttcacaactattgacgagaatggaaagtgtacctttttctagatggcatttaaagcctcgtatcattatgggatctgccaccttttttgatgcttttgatgctctgtctttagcgtttgttctcccagttctcatcggcatgtggagtttatcacctgctcaaattggtcttcttattggatctggttatataggacaagcgattggtgccattttctttgggtggttagcagaaaggcgtggccgtgtttttagtgcaaagtggactgtactcctcatgtccgtcatgagtattgcatgtgtgttttcaggtaattttatggcactgtttatttttcgttttatacaagggattggggtaggaggagaggtgccggtagcagcctcatatatcaatgagctatcccgggctcaagggagaggtagattttttatgctttatgagatgatttttcctttaggtttaatgatctcagctcaaatcggcgcatttgtggtacctagttttgggtggaagtggatgtttttaattggaggtattggaggtttaatcgtctttgtgttcttttttatgttacgtgaatctccacgatggctgatttcgaaaggcagattagatgaggccgaaagaattattgtagaaattgaagctagtactgacaaacgaatgcctgtaaaacaagtatctaatagtactgaaaagggcgactggaaagagcttttttcaactttctaccgtaaaagaacattgatcgtatggggactatggttttctgcctactttgtatcgaatggtttaaataactggttaccaagtctttataatacggtttacaatttgccagttggagattcattaagggcagcctctctgacaaatattttacagactgtcggtgtattcgcttgtgcatttttgattgataaagtaggacgaaagcgctgggcaaccattgcatttattgtaacaggtgctttattaactgctttatggatcagcggagcgagttctccagaaagtgtgatctatttagggtccgctgcttacggaatgatggggacaatcacagttcttctctatttatatacacctgaaatttatccaactcgtatgagggtgattggaacggcatttgctactgcttggcttaggctggcctcagcgattgctcctattatgataggctttattttagaggtgagcggtgtttcaactatttttattcttttcgcaagtgtgactatagtgggagcaattcttgcttttaaaatgatcgaaacgcgcgagaaagtattagaggatattgcaccgtgattgacgcacgcagtgaagaacttattccaaagagggtaggttcttttttattcagaggatctacgtacaatttttaaaatgcctaaccgatctccgttcatttatcatataatagaaacatgaaaagccatacctgtgagacagtgaagatgtatatccgaaataaaaaaagtctaccgatgaaggtagactttttctataagttcaattcttggttccttgaatgagtgcagcttttaagcagaaggaaataggctgctgctgtgcatcgaattgaagctgaaatagctgctttgtatcagggtctgcggcttgaagatgggaaacgatctcctgctggacattttctggtgtgcgtccacgtatgatccagtcctgataatcaatttgcagatcccagaaacgaatctctttttgagttagttggttggcagcgaaaagctcttcccattctgataaagagctttctcgcacatgagaaggatctctgagtctatttaagtgattaatgaatgaatcctgtgccgcattctcaggtgcataatggtcgacgagcagaaatgcgccgcctttttttaagacccggctgatttcagacatggctgcgggaaggtttggaaagtggtgagcggcaaaccggcacgtcacgatatcaaatgattcatcagcgaatggcaatgcttctgcggctgcccgttcaaaagtaatatgttccagctggcgttcttttgcaagtgctgctgcaacctcgatcattttttgcgtgacatcaatgccgatccctttagaaataatgtctgaaaaggaaaaaacggtatgccctgctccgcagccgatatcaagtaaatgctcatgacccttcgtatttgctgcctcttttatccattccaactcttctccggctgcaaatataggtgaatctcgatagttctcggcattttgtgagaattggttttcggctttagcatatggattcaattttttctcccccttttgttgtctctttatcgtaaaattccttttgttatttgtctaagacataaaagatatggcatgaatagttaaaacctatgaggtgatgaaagtggatatacgaatgatggaatatgtcatggaagtgtaccggcagaaaagttttacaaaagcagcggaccagcttcacattgcacagccttctttaagccaacaaataaagaagctggaagaggaattagacacacccctatttattcgaaagtatggacaagtcacacccacacctcaagggagccggtttattaaaagggctgagaacattttgaaggaaagagatgatttgctgcgtgaaatgggagaagcagcttatgaggtggggaaagagttgaacattggggcgccagccgtcacagggggatatgtcttgcccggtttattaaaaaccttttgccaaacgtatcctcatgttcacgttcaactaatagaagaatcacctcgtgagctagaaaaacttctattggctggtcagctggatttggctattttatctatgccggtcgagcatgaatcattgaaaacgaaacacatgctgacagagccgcttcttcttgcagtaccgccatctgctcaaccttggttacaggcggaattgaacgatatcatcaatcaagcagatcagaaagggactgttccgtttcgccttctggaagacgctgcattcattatgctgaaagagggatatggctttcgacaagtggtcacagaactttgtcatcatcatggttttcagccgaagataacctttgaaacaagtcatattcaaacagcacaggcattggtcaaaaatggactaggtgtgacagttgtgccgaaaatggtggtacaagaggaaagaaacgaagtcacttatttgaaaattgattcatgtccaacccgcacacttgtgtttgcatatgtggaagaaaggtatttaacgaaagccgctcaagccctaatggacctttatcaaaaagcttaaacaaacgtttaattaaatgcaaaaagcaggggagcaccctgctttttaataaatatccagacgctgatctgtcatcacaggaatctgctgtctcacttcatccactagctgaagatcaatgtccgcataataaatatcttcctcatggtttgtttcaagtaaaatacggccaagtggatcaatcaccatggagtgtccagggaattcattgtctctgcttgtgcctgttctgttaacagcaatcataaatgactgattttcaatcgctcttgcgataagcaagctgcgccaatgatctactcttgctgacggccattgcgccgtattgataagcaccttcgcccctttgttgacaagtgttctggaaagctgcggaaagcgaaggtcgtagcagatcatcgccccgatctttacatcctcatcatagtcaaataaaccaagctgatcaccagcggttaaatagttgtgctcatccattaagcggaataaatgaattttgtcataatcgactaaaagctcaccttggcggttaaatccatacatcgtgttggtgatcctctcatcttctgtgcgcttgttcaatacacttcctgcaatgagaacgacttggtgcttacgggcaaaggaagagaaaagctgttttgttcgttcaccgtttacatcagccagctgatcggctttttcaagagcgtaaccagtattccacatttcgggtaaaatgatcagatcaggctgctcgcggatcgcttcttctaaaaatgcttctgctttttgaaagttcacatcaggttctccaatttgtacgtccatctggacaagggcgattttcatacaggttcctcctttattcgatgattgcgaatgtgaaatccatgaatggatttgttgatttgttttgtctaagaatctctagttttcaagccagtttctttatcataaaggtttcaatcttctttgccaatagaaatgtcagaaggttttgtcttttgtggtgaaaatgtctttcttcgtcaagaaaacagtgatatgatagccataactaataaaacaaagggggatagtaggatatgcagttgtttgatttaccgttagatgagctaaaaaagtataaaccgaagaaaacagcacgtcctgatttctcagacttttggaaggcatcgcttgaagaactgaaccaagtggaggcagagccagcaattgaaccttatgattatccagtaaagggcgttaaggtgtaccgcctgacgtttcaaagctttggtcaatctcaaattgaaggctggtatgcggtaccagatcaaacaggtccgcatccagcactcgttcgttttcatggctataatgcaagctatgacggcgacattcatgacatcgtcaattgggcactgcatggctatgcgacatttggcatgctcgtccgcggtcaaggcggcagtgaagataagacagtgacaccagcagggcagtctctgggctggatgacaaaaggtattttatcgaaagaggcctactattatcggggtgtttatttagatgcggttcgagcgctcgacgtgattcagtccttcccagaagtggatgaacaccgaatcggtgtggtgggcggcagccagggtggtgcactagcagttgcagctgcagcactttcagacattccgaaggtcgtcgtggcagattatccgtacttatcaaatttcgaacgtgcggtagatgtggcattggagcagccttatttagaaatcaattcatactttcgcagaaacagtgatccagaagcggaagaaaaggtatttgagacgttaagctattttgatttgatcaatttagccggatgggtgaaacagcccacgttgatggcaatcggtttgatcgaccaaatcaccccgccatctactgtgtttgcggtatacaaccatttagaaacagataaagatttaaaggtgtaccgctattttggacacgagtacatcccggcttttcaaacagagaagcttgccttcttacaaaatcatttaacgaattaaaagaaaagaggccactctctaggagggcctcttttttaatagttcgtattctgtctcgttttttcatcaggcactaacgcggtgataatgagggcaagggcagtgatgatatgaagaatgaatccgagaatcggaatccatgcaaggcaggatgtgacaattccaatgatacttccaatcattggtccctggtctcgcttcgataagacgagtgtgataatatgcagaataagcatgaccatgagcggcgaatagccattgctaataacgaatagacctccgatcacagggatagcaaggcaagcttcaaaaatcccagtgatccatttcataatgcgagatatagacatcagatccaactcctttttcatatatgtcttattcgtattttcccaaaacgtgaagaagtcatgcagaattctatagaaagagttgatggacacttgagagagagaattaaggaagagctgaaaatcatcgaaacaacgtatgacgtaaagatttgtcttgccgtcgaatcaggcagcagggcatggggatttccctcgaccgatagtgattatgatgttcgctttttatatgttccccggaaagaatggtattgggcgatggaagagcatcgtgatgtcattgaacggccgattgatgacatgcttgatatcagcggctgggagcttagaaaggcactgcgcctattcaataaatcaaatccgtctattatggaatggctgtcttctgatatcatctatgctgaatctttctctttggcaaagcagctaagagaattaaaggatcgagcgttttatcctgcggctttgatgtatcattacctcaatatggcgaagcggaatgagagccggcatttacgaggagagcaggtgcgaatcaagaagtatttctatgtgcttcgtcctctgcttgcctgtcagtggattgaacgttaccgaacagttccaccaatggactttcatgaattactcaaggagctagtggaggaaggcccgctgttagcagaaattcacgaactgctcaaacgtaaaatggacggagaagaaatggatgtagagaaccgtctcgctcatgtccatccatttattgatcaagagctggcgcgttttgatgaattggtgaaaagctacaatcagccgaaagacaatctgatgcaagaattaaatgagcttttgcagtctacccttgatgaggtgtgggcgtaggaggggagagtcagccggatagcggcagactctttttttatctcttattgtgataaaaccacaaaaaaagtcagaatttttgtcatcttcaaatattgtagcggacagcttatgagccttacaataaagacatagcttacaaagagtgggaggtgccctttatggagtcggtcacaagaaatttcttcttgtttttgtcaaagagcagtctcttgaaccatattgctcgtaattggggaagtgctgttgcatctaagaaaatcatcggtgggaaagattttgagagcgctatctctgtcattaaacgattaaatgatcaaggaatggctgtaacagtcgatcaccttggtgagtttgtcacaaaggcagagattgcaaatgagcggacggatgagtgtattcaaaccattcagcggattgcagaggccaagctcaattcccacgtgtcactcaaaatgacatcacttggactagatattgacgatgaccttgtgtatcgcaatatgaaacgtattttagatacggcagaaaaacaccgtatcatggtgacaatcgatatggaggatgaacagcgctgtcaaaaaacgctggacatttttaaagagatgaaatctcaatatgagtatgtcagtacggttttgcaggcgtatttgtacagaacagaaaaggatcttgatgacctgaatgagctgaatccatttttacgacttgtaaagggtgcctataaggaatccgccgaagtggcgtatccaaacaaaaaagacgttgatcagaattacaagaagctgatcgaaaagcaattactcacagggaactatacagccattgcgacacatgacgatcaaatgatcgagttcacgaaaaatattgtgaaaaaacacaatataccgacaagtcagttcgaatttcaaatgctgtatggcatgagatcagaaacgcagcaggcacttgtgaaggaaggctatcaaatgagagtctataccccgtatggacgagagtggtatggctactacatgagacgtcttgcagaacggccggcaaacattgcctttgctttaaaagggatgacgaaaaaataatttgaaacgggagcgtgacaaagatgacaacaccttacaaacatgaaccattcacggattttagccaggaagaaaaccgcaaagcgtttgaacaagcattagcaaaggtaacagaatcactaggtcaaacctatccgctcgtgattaatggagaaagaatcgaaacgaaagaccaaattgtctcgatcaatccagcgaaaaaggatgaagtcgttggaaccgtatcaaaggccggaaaagaagaggcagaacaagcggttcaggctgcggcgaaagcatttgaaacttggcgctatacgtctccagaagaaagagccagcgtcatcttccgtgctgcggcaagcattcgccgtaaaaagcatgagtattcagcccttcttgtcaaagaagcagggaagccttggaatgaagcggacgcagatacagcagaagcgatcgacttccttgaatattatgctcgtcaaatgctggagctggcgaaaggcaagccagtgaacagccgcgaaggggaacacaatcaatacgtatacacaccaactggcgtgacgctcgtcattccgccgtggaacttcttgtttgccattatggcaggaactacagtagcaccaatcgtgacagggaacacagttgtcttaaaacctgcaagtgcaacccctgtgattgcggcacgttttgtggaagagcttgagcaagcaggtcttccaaagggtgtggtgaactttgtaccaggaagcggagctgaagttggagattatttagtcgatcacccgaaaacaagcctgattacattcactggctcaagagaagtagggacacgtatctttgaacgcgcggcaaaagtacagccaggtcagcagcatttaaagcgtgtcattgctgaaatgggcggtaaggatacagtggttgtagatgaggatgcagacgtcgaattagcggcaaatgccattttcacatcagccttcggtttttcaggtcagaaatgttcagctggatctcgggctgtcgtccacgagaagctgtatgaccaagtgatcgagcgagtgaaggaaatcacagaaacgaaaacaacagcgaaccctctttctgcggatgtctacatgggacctgtcattgatcaagcgtcctttgacaagatcacggattatatcgaggtgggcaaacaggaaggccgcttagtgactggcggaacgagtgatgattcggaagggtacttcattcacccaaccatttttgcagatcttgagccaacatctcgcttgatgcaagaagaaatctttggacctgtcttggccttctcgaaagtgtctagctttgatgaggcacttgaagtagccaacaacacggaatatggtttgacaggtgctgtcattaccaataatcgtgatcatatcaaccgtgcgaagcaggagttccatgtagggaacctctactttaaccgtaactgcacaggagccatcgttggataccacccattcggcggattcaaaatgtcaggaaccgattcaaaagcaggcggtccagattacctagctctacacatgcaggcaaaaacgattagtgaaatgttttaagttggaaaagcatgaacctgtgcacacgggttcatgctttttttgcttgtctacgacttgtttctatgcaaatctgtccggaaagaagtatgataaatgtattacttaatcagggagcaatcgggatggaagagatattagaaaagcttcatacattttttgatgtcgataagttaattgcatttattagcgggtatttaaaaaaacctgtgattttagaaagcacagagtgtcagctccttgcttataattcttacagcattcagcagtttgacccagtcaatcagcaaacgattttctcaaaggaatgtccggggtctgtagtcgattggttaaagaaaacaggggttatcgagcggcttcacaaggagtcaaagcctttttatgtgagcggtcatgacgagctcgggtttaatcggcgggtggctgtgagtgccaagcacaaacaagaggttgtgggctttatttgggtgcaggacattgaggattctctcacgcaggaggagctgcaatttttgcatgaagcttcctttcaagtgggaaaagtgatttataagaataaaaaacagctggagaaaaaggaaggcaagattgaagaatttttcaaaaaggtcatggatgatcatttttatacagaagaagaactgaagtgggaggctgagaatttaagcatcccgctgccagcggtatttactgtcatggtcgtacacgctgccgataacaaaagtgagacggcagaagatgtaaaggatgtcattcgtacgtatttgcagcttgaagataaggtgaatcacgtatactccgttcaagccgacattgtcgtgatattgggcagcttgtcagaccggcactcaccgaaagccactgcggctgacgtcatcgctcacctgcaatcgaaagcgcatgcccatccttctcctttgtatattgggatggggagagagtatcgagatgtcatgaaaatgagcacaagtcgatttgaagcgatagaggtcgtgaaggctgtgaaaattgtggggggacaagagctgattccatatgattacgagaatctgggggttttccgattcttagactcgatttacagccatcaaaaaaagaaaaatgatttcaatccagatttgttacgtttgaaggaaaaagaccgtgacagccaaacttcatttttaaaaacgcttgaagtctacttgttgaataactgcaagctaaagccagccgcagagcagttgtttattcatcaaaatacattaaactatcgaatgaaacaaatctttgagatgacctcaatcgatttaagtcacttcagccagcgatgtgagttatttattgaattaatgctgatgaaaaaagatcaatagtcatcgaatccgcaggtgcccgtgatcacctgcgggttttcatgtgaaaaatggcatacaacggcttcgctacgttgtatgatagataaggattttatgagagagtgaaagggggaccacctttgggagcagtcaccttggccattttgattttcatcctgaccctcgtccttgtcatttggcagccaggacgtttaaccattggatggtcagcgtgtggaggcgccattcttgcacttgcctttggtgtcgttcatctgggcgatgtgtgggaagtgacgcaaatagtatggaacgcaacatttgcgtttattggcatcattattatttcgttaattttagatgaaatcggtttttttgaatgggctgcactgcatatggcaaaagccgcaaaagggaacggtgtccgcatgtttatttatttaacattgcttggcgctgtcgttgctgctttttttgcgaatgatggagcggctctgattttgaccccgatcgtcttgtctgtagtgagagcgttaaagctggatgagcggatgatcctgccttttgtgatggcgagcggctttattgcagatacaacctccttgccatttgtcattagtaacttggtcaatatcgtatcagccgactattttcatattgggtttctagaatatacagcaaacatgttcgtgccaaaccttgtgtcgcttggagcgagcatgctagtgctttatgtgttttaccgaaagctcatcccaaaaacatacgatctgtcacaagcgaaggaaccggcttcagcgatccgggatatccgcatgttccgcttgtcttggtatgtgcttggttgtctgcttatcggttattttgcaggggaactcattggggttccggtctccatcattgtgggcggtattgcccttgttttcttgtggctggccagaagaagtccgcaagtggcaacaaaacgcgtcataaaagaagcgccatggtccattgtctttttctcaatcggcatgtatgtcgttgtatacggactgaagaatgtcggtctcacagaaatattggcggcatggatcgaacaaggagcatcgcatggcttgcttgcgggaacgatgtttatgggtgtgctcgccgcagtgctgtcctcagtcatgaacaatctgcctactgtgttaattgatgcgattgcgatcggtcatacagatacagcaggcgtcatgagagatggactaatttatgccaatgtcatcggctctaaccttggtccgaaaatgacccctatcggctcattggcgacattgctatggcttcatgttcttaagaaaaaaggcgtccatatctcttggggtgcatacatgaaagccggaatcatcctcaccatcccgaccttgattcttactttattggggttatatgcatggttatggttcatacattaaagctgaatataaaaaagagcaggtcgcttggatctgctcttttttgttacagatattttgcatagcgtttttctaaaaagtcctgaagcaatgagactacactgcaaatgccccagtaaatgagggcgaccaaaatatacatggtcatataatcgaattcgcgcccacctacgatttttgcttgctggaacagctcgggtacagtaatcattgcagccagtgaggaggctttgattaaatcgagcatgacattggctagtggcggcagagcgatgcggacggattgaggcaaaatgacaccgcgcatcgtttgccaatagctgagacctagtgacttggcagcttctacctgtccgcccggcacagaggagagagccgcccgattgatttctgcaatataggcagcgctattgaagctgaatccaataatggcagcagtgaccgctgtaaactcaatcccgatataagggaatccaaaataaagaataaacaaaatcaccagaatgggcacgccacgcatgaatgagatatacagccgtgcaggcagccgaagcatccacgtattcgccattctggcaagcgcaataaaaaagccaagaatggtaccaaaaaacatgctcacaaaggaaatgagcagcgtcagccagatgcctttcatgacaaatggaaatgacgcctttgccagtgcaggattaaatatatattctaaatgaatatctcccacgcttgcggctccttatttcgaaatgtcgacatcttcgacatcagcatctattttctttgaaacgtctgcatgattaaagaatatttcggaaatctttttcatggttccgtcttttttcatttcttttaagacacgatttaattctttttgaagctctgtgttgtctttcttcatcacaaaaccttgttcgtttggcatgtattttaagtcagggtgaatcgtaatatttaatttcgggaatgcagctagagctagtgtctgcaagtaataatcattgagaatgacatctgtacgaccgttagcgacatcctttaagtattgctcatttgtcgcattatcataaataacttccttcgcaccgtacttgcgagcgacatccatataaatcgttgtggcagcaccagctgctttctttccttttaaatcttttaacgttttaatgccagacaaatcatcttttcttacgatcgccgtgccataagaatatttataaggagttgaaaaggcgaacttatcttttctgtcatctgtgatgtcaatgtcatttgcagcggcatccacttgaccagaattaatggcactcagcatgccatcatagcccatttctttaaattctactttcacatcaaggcgtttaaatgcttctttgaccacttccacttcataaccagtcaattgatccttgccattagctgtatcatgatatgacgttggataaagggtacctgaagtagcaaccacgattttccctttcttttgaatctcatcccactttgaatctttagactgtgaagagcctgattgactgcaagcagacaagacaagtatgaaagcagacacaacaagcattacccagatcgattttctatgataaaaacgactcatttaagaatcctcctctattttttatacaaaacaaaacatagcacgctttttctgttaggacaacgttttcagaagaaaagcaaaaaagtaagaatattatgtgcaatttgcgcgatgaaataatgtataaaaaaggaaagtgcgtacaaaataaatgcgtataaaggagggaagaaaatgatgaaaaaaataagtggcttgatcatattatcgatgatgctgttgtctggtttttatatggaaacagctcatggagaaacaccccaaatggaaaagcgtccagtaacgcatcaagtaaaactaacgacagaacaacaaaaacaaattgaaacgcttgagcagcaaattctttctaagcgaaaagaagtgattgagaaatatgtccaatatggtgtgttaacaaaggaacaaggtactcatattacgaagcgaatggatgagcattacaatcatttgaaaaacaacggatttgtgccattgctgaaaaaaccacagcaccatcgaccataaggatgaaaccggcagcgaggtgccggttttttattgtttgagattcttttcagaaggtgagactttcaccatcttgagggacaaaaatggcttgttctgcttgatgctcctgaatgtaagcttgtaaagaagctcttgttagcaagcagtgattcactgcctcaaggtgacaagcgacaatttgtgctgttgggtgagaatggtgaacctctaaaatgtcttccttcgtcatcgtaatcggatcgccttctaaaaattgagcagctccgctattgaccacaatgacatcaggcttgcgagtattgacaacctccttcggctcatcacacaaaatggtatcacctgcaatgtaaaggataggttcatcagggtgagagaaaacaaaaccgctgacttgtcccatccgcttcgctgttactcctgtcccatgctgtccacctgtccgctgaatatgaacaccacaaatgtctatttcatcttcaatgcaaatgacatgctcgaaaccggcttcttcaacgtcttttttgtcattctccgattgcgtataaatgggctggttttgggctaatttttgtttcgcctcgtcatcaaagtgatccacgtgcaaatgagtgagtaagacagcatctgggtgtagcatgttgtctaagtcaatgtttataggcagatcaacaatcggattgttcaaatgttgattggctgtatgaggaaacggtggatatgttccttttgctgctaaaaagggatcaatgaagaaagttgcctgcccatattcaaggtataaagtagcattccgaatgagcgtgattttcataaaaaggcctcctttttttctgattaagtttacagtatattaaaagagttccatgtgacagagggtaatgaaagtctttcatcagagggacttgatttttgaaagaggtgagccaatgttagaccaaaccgatatggatattttaaaagagctctcaaaaaacagtcgattaaccatgaaagcgctaggtgaaaaagttcatttaacgggccaagctgttgcaaatcgagtgttaaagcttgaagaagagggtgtgattgaagcatataccatttcgattgactggcggacgcaaaagaccatccaaacatttatgcagctctatacccgaagtcatcatcacgaaccacttctgtcatttctcgaccaacaggaagagatcaagaatttatttaaaataagtggtgagggctgttatatggctgaaggccatttctccagtcatgatgaactggatctgtttttaacggagctgacaaattacgcaaattataaactgtctattgcggttaagcgtctcattcatcagtaaaagaagagacgcaggaggataaggaaacgatgaaaaaattaatcgaaaatcaagctgaaccggtgacaaaggaaaaaatcaaagcagacttggttcaacttggtgtggaaaaaggcatgattttatgtgttcactcatctttatcatctatcggctgggtaaacggtggcgctgttgccctcatacaagcattgatggaaaccttaacagaagaggggacactgatcatgccggcacaaacgttagagctttctgatcccgctgattggatcgatccgcctgttcctttttcatggtggaaatcgatcaaagacacgatgcctgcatttgatccagcttactcgatgccaacagcaatgggaaaggtagtagaaacgttttggaaatacccaggcgtggcgagaagcaatcaccctcatttttcattcacggcttgggggaagaagaaacatgagcttctgaaacaccacgcactttcttttggattaggagaacattcgcctctagcccgcatgtatgagcttcaggctcaggtgctgctgattggtacgtcttttgaaagtctgacagctttccatctggctgaatatcgcatccctcagcaagacctcatgacaagaggagctcccatcttagaaaatggatggagagtatggaaagaataccaggatattatcacaagagaagaactatttgagcagatcggccgtgactttctgcaatcaggaggcactcatcatcacggacaaatcgggcttgccagttcatatttattaccgatgaaagaatcggtagattttgcggaaaagtggcttgatttgtacgatcagtcgtgatctacacagtttggaaattgatatgataaaggtcttgatcaggctgctgtgaagtatagcaggtgagctgatagtctccctttggaatagggaaagacagtacctgagccatgacgcttgtgagataaacttgatcgcttgcatgagtaaaaggtactgtgactgttctgtcagccgaggctgggggcatatcgctatttaaagtaacagtaacagatgcttttccgttgttgaccccttcaaaggatacaccgtgatctcccatggcgaatccttgaagaatgtcatcatctgaccagtcaatcacaggtggtgttttgcttccgctgtatacggtgatttgatgataggagatagatagggaataggcttggtttaagttattcatttaaaaaacccctttatacatagatttcggttggaatgtgaatggttgaaagagtgaatcttgaagagaatgttaggcagcaagacgattgtcgccgtcttgcgcttctatatgaggaatctagatgtgaaattgtgaaaccattgcttttaaatctcctgctaaatgagcaagggcttctgatgaagcagttacttcttccattgcggcaaattgttcttctgttaagccggctacttgctgtgaatgttcactcgttagtttaaccacttctgtaatagtggcaaaggattgtttcgcatcgtttgtataagctgcgattttttgtgatgcactagataaatgcttgatgccatctgccatttctctcattgactgttgaatatcaataaatgattcttctgtatgagaaataagtacagacccttgagccgcttcctctcttactcgtttgatcgcatttgttgaatgagtcatctctttttggatttcagaaatgagatgggaaatcatatttgatgaggcttgagattcttcagcgagctttctcacttcgtctgcgacaactgcaaatcctttcccatgctcgcctgctcgtgctgcttcaattgctgcgttaagagcaagcaggttggtttggttagcgatgtctgtaataatatgggaaatatgatcaatttcagccgaacgtgtttctaatgcttgaatggctgtcccattttcctctattgattgtgcaatagatgtcatttgtgagtttacttccccaatattctccacaccttttagggccatttcttgtgcaaattgacttcttgaagccatttgccctgcattttccgtgatgtttgccaactcgttagatacttgaatcatcgtgtgcacacttgttgtcatttgagttgactgttcttctgatgaatgagcgacttcttgaatactatgggtgattttttcggatgctgcacttgtttcctctgcactagctgacagctgttcagatgaggttgccactaattcagatgtgttcatcacattaagaatggtgtgatttaatttttcccgcatcttattgaaatgatcagccaaatcagacagttcgtcgcctgctgtatctgtcacattgatggtcaaatttccttcacctgcactcttaatggcagaagccataagcttgagacgggtttgaatccgctttgtgaaaatagaaataatgattacagcaacgattaagcttaacaacagaacaatgaaaaattgaatgtagaatgactgaagcatttgtgaaatcatgctttggttggcacccgtataaaaaataccgatcgtttcacctgcatcatttttgattggcatataagccgtttggtagtctttcccagcaacatttgctgtgccgtaatagttttcacctttatctaatacagtggccttcacttctggtgaaacttgtgtaccgacagctcgttttccgtttaacatgacattcgttgcaacacgggtatttccttggaatattgtgatggtatcatcggtgtattctgctaaatggtcgaccaatgtatcatgatcattgatttgggtattccctttgtaaagctttccaccttttatctgccacgagcctgctactttttcatctaggtaggcatagcctagctttaaatcaccttttgctttttcagtggccatgtgcttgatgttttctgtcatttcacgattcaccacataaccaacaattgctgagaagataatgatgacacttaaaaagatcagcaaaattttggcaccaagcctcagttttccctttttcttcatgctttttgactcctttaggtataaggtaggataaacctccttaaggattatcggcatgaaaaaaatgtttgaaatacctgtaagcagttacgaggaaattttttttagatagaaaagggtcatgtcgttaatcgatgataaattgtattcttgtgccgtcaggatcatctgataattgatgaccgacccaagagcctgctcctctattatctgaaggactaatgtatttgactgaagctcctgttcctccttccttacacatcgccatcggccattcgtcccgatcatatccgcgctttgttgggatgccatgaagtgattgttctctttgttcatcgctatgtttacggtcaattgtacatacggatgaatggccttcatcaattgcctcttctatgtgcttcgcggtttcggggtaacgatctgatgggaagtgaatcgttttgtcataagatgaattcgtcgtctcttgtttaccttgctccagctgaatatagcctgttgctacaccaacgatgatcagtaaaagcaagagaatgattttaagaagtttcatagatgctagctctctttcttgtttgcgtattttgtaaacagaagtatagcagaattacttaccaatttctcctggttttgaaaaaacgccttttaaagttcgaaaaacggtttttatccgttttcttgcttttcacatctaaaaaaattcataaaaattttaatttttcagttcataaaaagaatatgctttatcaaaatggctttatcactgctttttgggctaatttcaagaatttaacacacagaaattttaaaaaaataaaattgactagaccgatatgctttaataatatggagtcaaatatcaaaaaatgtcgtaatttatcaaaatatcattctatttacattgtaggagggaagtacaaatggcggatgtctcttatcggcttggtatagacataggcggaacatttactgacttatcgctgatgaatgaagcaacaggggcgttaactgaactcaaaacacccacagtgactgacgacccagctcagggaattatcaatgggctaaaacttctaaaagacagaggtgttgatttatctaaaatccaatatctcgtacatggcatgacaatcggtcttaatacattgttgcagagaaaaggagcagatttggccctttttgtgacggaaggctttcaagacatattgtcactacagcgtttacgactacccattccttatgacttcaattctcgtttgccagaaccattaataccacgaaagcacgtatatccaatctctgaaaggttgatacacgatggtacgatcaaaaaacctctccatctgcagcaattagatcatgctgtccagcaggtcatgtctaaagggctagcaggtattgttatttcttttttacatagctatcaaaatccagttcacgaattacaggcaaaagcctatatcaaacaccattatccgcaattagaagtccttacttcatctgaattatggccccaaatgagagaatacgagcgtaccgtgatgtctgttgtcaatttgtacatccaaccaaaggtgaaacagtatttacaaacattgaaaagccgtttgaaagaagaaggtgtaccaatttctccatacattacccaatcaaatggtggtttaatggatgcagaaagtgcagcaacttcacctgttaaaacacttttttctggtccggcagctggtgtcattggtgcggcaagaattgcagcttctgcaaacgaatccaatctcatcacgtttgatgttggggggacgagtgcagatatttccattattcaaaatggacagcctacaatggctcagtcaaatcagctttcaggttttcctatcattcttccatctgttgcgatgtattcaataggggcaggcgggggttctgttgcatggattgatcagggcgggcttctcaaagcaggaccagaatcagtcggctcacaaccgggacctgcttcgtatggtaagggaataaaagccgctttaactgacgcgttcctcatatgtggttatctcagtcaagaacgttttgccggaggacatctacaactacagctgtccgcggcagaaaaggcctttcagccaattgctgaccagctcaacaaaaaagtagaagaagcggctgaccagctgattcaagtagctgtcgccaatatgtacacagaattaagcaatgtcatggagcagcaagggtttgacccaagagattttagtttactagcgtttggcggagcaggaccagttgtagcgaatttccttgcgcgagaaattcatgcgaaaaacgtggtcgttcctccaagtccaggaacattatgtgcattaggtgccctgaacgctgattttattcatgatgcggtgctgtcgaagaagatatgcttacaagactactcgatagatcaactaaaacaggattatgagatgctttctcgaaaagcgactgattggttcagtcagcagaacattcagcatattaaacagacatccattctattattggcagatgcacgttatcaaggacaagcctttgagattgaattaccattatcagctgaatggctgaagcaagaacaagatatccatcaactcgttgaagcctttcacaaactacatcaacgtcaatatggtcatagagatgatcaggcgaacatcgagttcactcatttacgagttcgagttataggcgagacgccgccgctgcctttcacacctgttcatgaaagcagcggacaatctttgaagccacatgaattcaggcgaatctttatagaagaaaaagaatatgaagcagctatttattacagaaatactttgtcagtaggttctgtcattaatggacctgccatcattgagcaggatgatacgacaacattgattctgccaaattgggcaggcagcattgatcaatcagggaacttggtgatttcaagggaggcggctttacatgagaactgatccagcaaagcttgagatgatgcgcagttattttaatgcaattgcatctggcatgggacatgtcattgagcggacgtcttttacgactttcgttaaagaatcagctgactttgcgacagcgttagccacgccttctggagatttctttgtttatccgaagacagtgggtgtcacgatctttttagggctgagtcttaaaaaagcgattgatgagagcggaccaatgcagccaggagatattatcatcacaaatgacccttatacgacagatggtttagcgactcatctgccggatgtccatatcattaagccgattttcgtagatggtgaaattgtcagttatgcttggtcttttgttcatgtaagtgatgtgggcggacttgtgccctcgagtatttcaccgacagcgacagatattcatcaagaaggattaagaataccgccagtgaaaatttatgaaggtggaaaagagaatcaggttgttcgtacttttttaagagccaacagccgagctggtcatttaaatgatggggatatcaatgcaatgattgctgcagtaaatacagcagaaattcggttaaaggaaatgatcgggaaatttggaataaatgaagtgaaacaaggaatgatggacctcctgaaacaagctgaggttcgtgcaggaaaggtcattgaagccattccggacggaacgagtgaattcgctgattatttagatgatgatatgatctcggatgtgccgatccggttgaaaatcaagttaacggtgaaaggaaagcggctgacgcttgatttttctgagtgtgacccgcaagtgaaaacagcttttaaccttgtcaccaatggtcagaagcattcctttctatatcaaggattgattaattacattattagtaaagatccctttataccgattaatggcggaatcacatttccgattgaagtgatttcacctaaagggacgctagtgcatccagaatacccggcttctgttggtattcggcattcgattacgatgaggctgttcaatgtcgtgctaggcgccattggtaagctgttacccgaagctgtgccggcagcaggtgcaggtcaatctgccattgttgttctctctgttcctgataatcaaacaggtggcaggaaaatgtctgttgttgaaccattaggcggaggcggcggtgctcaaaatggaacggatggagtagatggtattgatcattcgtctggctttttgaaaaatacacccattgagagcttagaacagcatattgatattcatgttcaccgatatgagcttttgccaaatacaggcggagcaggagaaaacagaggtggacatgcgattggtttggaatttgaaatgatcaagcctgaatccatggtgaccgcacgaggtatggaacggatgaagtttcagccttggggattaatgggcggccgagcgggagctatcggtgaggtcaaactggtcacagcaaaaggtgaaaaacaagaccagccgaaaatagatgttctacgacttgaaaaaggcgatattgtgcaattgatatcaccaagtggaggcggatggggaaatccatttgcaagagagaaagaaaaagtccttcatgaagtagaagcaggtttattaagtgaagaaagagcgctacagcaatatggcgttaaagtgtatctagaccaaaatgaatggaagattgatgaagagcaaacgaatcagcttcgtgaaaagggtaatcaccctgctcatatcatgtgggatgtcggagaacacagagaagcttatgagaaagtatggacggatgaagccagcagcgagcttgctgtgcggctgcgctcctacccagctaacgaacgtacacattataaacatgaagttcatcaatatttcagtcatagaaatgagccgttaacaaagaaagatattattcaagcacttcgtcatatggatggacaaaaagggggaaatgaatcatgaaaagaagattaatcactatttttgcaggtgttctgtcattgattctactgctgacagcttgcggtgggaatggacaggatcaaggtaaacagcagcagactgtgatcgttggcgtatacggaggcgattgggaaaagaatatcaaaccgatcctcgaaaagtttgaaaaagatacgggaattaaagtccaaacagtctctggtgcggattctgaatggtttacaaaattaaaagcgtcaaatggtaaaaatccaccgtatgacctacttattttacagcctgatacgattcaaagaggcattgctgcaaacgttctttcacctatcgatgaagatcaagcaccgaatgtcaaaaaactttaccgctctgttcaaaagaagctcactgtcgatgggaaacaatatgcagcaggctttagcatggggcagctcggaattgcttatagaaaagacctcgtaaagcaggaaccaaacagctggactgacctatggagcagtcagctaaaagggaaggtagccatttcatcgccaacttattcagccgggttacaatttttctctgcgcttgtccatgctcaaggggggacagaatcaaatcctaaggatattgataaagcctttaaaagcctttcgcaattaaaagggcatgttgctgcttttccagataatccagggtctattcaaaccttgttagaacgtggtgacgtcgcagcagttccatattgggatggacgatcatttgcacttgaagaagaaggtatgaatattggtttctcatatccaaaagaaggcgctgttgcagcagttgcgagctgggctttaacgaagggaagtcagcatgaagaagcggcttacaaactattaaactatttaagtggaaaagaagctcaggaagctttctcggaaaaatcttattatggtatgtcgaattctgatgtgaaatacggtgacaagattagggggaaggtcaaggttggagagaattattatagcaagctgacttgggtagattacgaaacagcaacttcggagctgggcaattggacaaatcgatggaacgaagtattaggtggaggaaaataggtgatcgtatgagtggaatccatttagaacatatcagccagcatttcggcgagcagattgctcttaacgatgtcagtcttacggtgaatgagggggagtttttctcccttcttggtcctagcggctgcgggaaatcaacgttattaaacatcattggaggttttttagagccaacaaaaggtgtcgtctatattggtgatcaggatgtgacgaatttaccaccttatcaaagaaaaacgggtatggtttttcaaagctatgcactctttccgcatctgaccgtctttgataatgtggcgtatgggttaaaggttcaaaagaaaaagaaggcagaaatcaaagagaaggtaatggagagcttgtctcttgtgcaattagaagcgtttgcgaaacgtatgccgcatcaattaagtggtggacagcagcagcgggtagcgattgcaagagcgcttgcgattcagccatctgttcttcttcttgatgaaccgctcagtaacctagatgcaaaactaagaaaaaacatgcagacagagcttagaaatattcaaaggaatgtcggaattaccaccattctcgtgacccatgatcaagaggaagcattaagtctttctgatcgggttgggattttaggagagggtaaaatccagcagatcgggacgcctttagaggtgtaccgccagccaaacaatcgatttgttgctgaatttatcggacaagtgaacctatttgaggcagtctatgatgaagcaagtgctgcatttatcgttcctcatttaatccagtcaaacgggcaggaagttcagttaaaggcagcggcacaccaaaagaagaaggaaaatcagttgctcatgctccgtccagaaagaatcagcatatcttctgagcggggagacgttcagtccaaccatgtatcaggcgtgctgacagatgtcagttatattggtcactcattacgtttggtggtgggactcaatagaggtgaaatgattgttcatgctactgatgcggcatttccagagctgccgaaagctggagaagctattcatatcaattggcagcctgaagatatcgttttcctagattcgaaggtgcatacgtgatgcgtatcaagaaaaagaatcagcgatttcattggttcatgctgctgccagcgtgtttgtttcttgttgtatttcttctagtgccgcttgtgatgatgttcgtcctcagttttcgcgacgtggattcaatgatgaacacattacaaacgtatagcttttctcaatatattcatgtgtttacgacagatgcgtatgtgaaggcgattggaagtacagtgtgggtagccttgcagacaacagtgatttgtttagtgatggcatacccagcagcatacgtgctcgtcaaggcacctcatccacgtctgcgggcatttttctatatcttacttgtctcgccgcttttgacaagcgttgtaattcggacgtttgcgtggattgtccttctttcacaaaatggtctgatcaatggcatgttattagatttacatgtgattgagaagccgctctctatgctgtggaatatgaatgcggtgattattgcttatgttcaggtcatgctgccttttgcagtgctgcctatcgcgacgagcttaaccgatatggatcgtcatttacgaccggcttctatgagtctaggagctggacgaattcgaaccttctttcatgtgacttttccactaaccattccagggatggtgactggggctattattgtcttttcgctggcagctgggagctatatcactccgctcttagtcggcggaagaatgcagccgctgctgccgctgtctatttatcagcaagtcatgcaggtgtataacttgcctcttgctgcagcgatgtcctttacgttattggtttgtgtgcttgtcgttgtcagtttattaagctatctattgaagcgttgggaggcgaggatgcatgcgtaaaaaatcatttggtgatcgcttgctttcaagcctgatttggactgctgggtcattggtttatctctttttgaccatacctgttcttgtcatcgtcttatctgcttttagtccaaatgccttccctgaatttccgccgacttcgttctctgttcgttggtttcaagaggtcgtgtcgaatccagaatggatggagtctctgcgtatcagtgtgattttgctaatcatcgtaacgcctctcacggttcttttaggcacgatggcttcatatgctttagcaaggctttcctttaagggaaaggaggcgattcaagccttcattttgtcacctcttatgattcctcaagtagtgttagggattgccatgctctatttgtttacggctatggggtttacaggatctttgtgggcgcttgtcataggtcacgtcatcattggctttccctatgtggttcgaacagtaggcgtcagtgtctcgaatttggacccgcggcttgagctagcttcaatgaatcttggcgcaggacctattcgcacattctttcgagtgacgctgcctttgataaagccaggaattattgcaggcggggtattttcagccgtgacgtcatttggggaaatatcgatcagtttgttcgtttcctctccccaaacgattacaattcccgtcaggacatttaattacattgagcaaacctttgatccgagtgtcaatgcgatatctgtcatatttattatcatttctatcattgcgttgctcattattgaaaaaacaattggtctgtctaaggtgatgtaaatataatgaagaaacaagggagctgtcatttgaaatggcagctctttttgtgttgtttttacggtaaatattttcaattttttagggaatatagttcttaagatttaagaaattgtgagggatggaaggagacctctatcctacattttcggtcatattttcaaaatttaaggaaaaacatgaaaattttgcggtatttagtcaattattttcggttgaacgcaactattattagttattttcggtaaatatcgtaaattattatgtgattcattcggtataacgcatgaatctttacacccatttttcggtgaaaaaaacaataatttcatataaagtggacgtaaatagaaaatatttaaaaagaaaagaagaaaaaggcaaatctatggaaacgtagagacgcaaagccatgtcctaaggtaaaagttgttttttactatggtcggcaggctaccgaatcaaaatgggagtccctccgttttattcggggtgggcttctttccgtattctgtctattttaatgaaatagacttggttcttttgatatagagggtgcagggttgtcacaatggtggagaaaacacagaagaggcggaggatgaaaatgaatacagtttattaccccttaacacatgcgcaaaagcgagtattctacacggaaagattttatccaggtacaagtatttctaatttgggtggattcgccagattgagatcggtatcaggtttagatccatctttggtcgttgacgtgcttcaagcgtacattcgccaaactgactcccttcggctgaggctagtgtatcaacatgagcaggaggagcctgttcaatatatcaagccttatgaagaacagccgattcgcatggagaagggctggagtgaagaagaagtgagggcttgggcgaatgagcaaatccgtgagccgatgccgttgattgacagccccttgattgaatttacagtctttcaaatcagtgatgaagagtgctggctgttttgtaaagcacatcatattgtggcggatggtatctccattatcttgatgggaaatcgcatcatcgacttataccaggacatgctgcacggggtagacatctcaccggttgaggagatttccttcgttgaccatatcatgagtgagcaaagctatgaaacttctaaacggtttcaaaaagaccaagctttttggaatgagcaatttgccaatattccagatttcgcttctttaaaaccgcataagggatacgagatgagtttacatgcggagcgattttcaggggatattccagattctttgaaggagaaacttcgtgcgttttgtgaagagcagaaagtcagtatgctctcgatgtttatgtctactgtttatatgtatttgcatcgttttagcggtatggaggatgttgtccttggaacctttatgggcaaccgaacaaatgccaaagaaaaaaagatgattggtatgtttgtttccaccattccgatgcgtgcatctgttcaggggtcgcaatcatttctggatttcgtcaaacaggtcatggcggatcaaatgaagatcttgcgtcaccaaaagtacccttacaatcttctcatgaatgatttgagggaaagagaagggtttacaggacgcctttttgatatttctttagaataccaggtcatgcagtggcagaaaaaagagaatctgtcttttattactgaaccgatctttagcgggagcggaatgaatgatatttccattcatgtaaaggaccgttgggatacagatacattgaccattgatttggactaccgtacagatgtattcaccgaagaagaaatcagtcagatgtttgatcgattcttaatcatactagaagcggcagtctcccagcctgatcagctgatcgggaaactccctttacttccacaagatgaacaaaaggaactgctgcaattatctcagagaaaaccgtttcaaaaaccagctgaaaagccagttcatcatttgtttgatgaggcagccaataagtatgcagagcggaaagccgttgtagcagaaaatggagcattgacttatggagaactgtatcaaaaggcagaaaggctggcgcgttttttacaaatgaaaggtgtctcgcgtgatgtgcctgttgctgtcctaatggatcgaaaggcagaggctatggtggcgatcttcggcatattaaaggctggcggggcgtatgtaccgattgatccggcattacctgaggagcgcattcaatatattgtggaggattctggtgcttccattgtgttaacagaggaaacgttcgtttcaacataccgtgccctctcggaaaaaatggtcgtgcagcagcaaatcgaattagatgatgaactgctgcctcagcttgtagatcaatcggtaccagaggatttggcttatatgatttatacatcggggacgactggaaaaccgaagggcgtcatgattgagcatcttcagctgcatcatttggttcatgccttgcatcatgagatttatgaggaggcgagtgagcttcaaatggcgcttcttgcaccattccattttgatgcatcggtgaaacaaatttttgctgcgatattatttgggcatacacttcatattattccgcgagaaacaacgagaaatggtgttcaattagcggcttattatagaaaacatcaaattgaagcagcagacggaaccccggcccatgtacagcttttacttgcagcggaattagacggtctgtcattgagacatatgttagttgggggagaggcattgcctgcgaaagcagcatactcgcttattgaagcggttcgtatgagtgagcctgcttttactttgtggaatgtgtatggtccgactgagacgtgtgtcgatgcggcggttcatcgcctagaactaagtgaacttcgcgaatcatctgaacagcagcgttatgtgtcaatcggaaagccgctcggtcatcaccgtctttatattttaaatgaccatgatcaattacaggtacagggggctgctggagaactgtgcattgcagggataggtgttggacgaggctatgtgaatcagcctgaattgacggagaaagtatttacggcagatccattttctccaggtgagcggatgtatcgaacaggggatctagtcaaatggcttccagatggcacacttgattatcttggcagaatggataatcaagtgaaaataaggggttaccgcatagaaacaggcgaaattgaagcagtgatggagcaggtagatggagtgaatcaagctgtcgtactagtagttgatgaagcggacggggaaaaggtgttaagtgcgtactatcaagcccgtcatgaagatgtgtcagttgacatgctgcaagccgctatcaaacatcagctgccagcttacatgatgccgctctatttcaaagagcttgatgcatttccactcactgtcagtggcaaagttgatcgtcgtgcacttgctgccttaaaaggtgataaagccgttcaagctgtttatgctgcgcctagaaacgatctcgaaacgaagcttgtgcgtttgtgggaagaaattcttggtcaagagaagattggtatatatgattccttcttcgaacgtggggggcattcgctgaaagcaatgactgtactcacacatgtgcagcgagattttcatgtagaggtgcctctatccattttatttgaacagcagaccattgcggctttggctgcctacattgagcaagcggaaacatcttctgaaacggtgatacctaaagcacctgctttagaccattacccattgtcacctccacagcagcgcgtttatatggtgagtcaattggagcaaagtactgcatatcatatgccagctgttgtgaggttaaaaggaacgctgcagcaagagaggctgactgaagcctttgaaaaactcatcacacgtcatgatatgctgcgtacgtcttttcatacgttgaaaggcgttcctcgtcagcgggtagctccatccgtaccttttcaaatagagcagctaacaggcggtatgatggaagaaaatatgcagaaatttgtcagaccctttgaccttgagtctgcaccacttcttcgcattggcttgaagtcattagatgatcaggagcacttgctctttttcgatatgcatcacctgatttcagatggtctttcgattgatttgatgctgcgtgagctatcagatgcttacgaaggatccgttaaagtcccattgaagcttcaatatcaggactatgctgtttggcaagaacaacaaaattttcaaaaagaagaggcattctggctgcaggaattctcgggtgatcttcctgctttacagctgctgaccgattatcagcgcccatcgattcagtcgtttgcaggggatcgtgtgatcaaagaaatcaatgaaacgttaaagaggcaattacaggagctagcggcaaaacaccatacgacactgtatacggttctgcttactgcttactatacattgcttgcgaagtacacggggcaaaaggaattcgtggtaggaacaccggcggcggggcgagtgcatgcagacttggatgacatgattggcatgtttgtccagacacttgcattgcggtcagaggttgatccaaataaaaccatgtcgcagttgatcgagcaagtgaaggaaaagacgatgcatgcatttgagcatcagcaatatccatttgaacgattgcttgaaaaactgaatatgccaagagattttagccgtcatccattattcgataccgtttttacactcatgcgagatcatggatcagcccagcatattggagaaatgcaagttgaaatcgaagaaaccaatttccatattgcaaagtttgatttaacgctgcaagcaatggagtcagatcaaggtttatcctttgtcctcgattacagtacggcgctatttaaacgaagtacagccgagcagatgctgcatcattatatgtatttgctggagcagatggtccaagcgccggaggaagcgatccgatcttatcgattactttctgaacaagaagcagaagctcaactgaatctgtggaatccgttaccttcgccttatccggcagaagaaaccattgtgacgcagtttgaagcacaggtggaggcgcacggtcataagcctgcactccagtgtgaaggcgtgattctttcttaccaagaactaaatgaccgtgtgaatcagctggctcattatctgcgtgaacatgggtttgaaagagggatgaaagcagccttattctttgaacgatctcatgagatggtactctctgttctagctgtacttaaggctggcggcgtctatgtaccaattgatcctgattttcctgatgagcgcgtgaagcactttttaacagacagcggtgcgcaattcttattgacacatcaagtgctgcgccatcgctcggtgctcgcttcttttgagggaaccatcatcgaaacagaagatcaggcaattgatcagcaatcagacagccctatagatgttggtattttaccagaggacttggcgaatttgacctatacatccggtacaactggaaaacctaaaggaaatatggtgacacaccggaacattttgaggacagtgaagcaatcaaattatcttgccattcatcatgatgactcggtgatgagtctgtcaaactatgtatttgatgcttttatgttcgatgtgtttggtgctttattaaacggtgcgaaactgattgttctgccaaaggatcatatcttaaacatgaatgagctttctggagcgattgagaaggagaaagtcagtattttaatgattacgacagctctttttcacttacttatcgatatgaaaaaagacagcctgaagaacgtcagaaaagttttgtttggcggagaacgtgcttctgtgcctcatgtcatgactgcacttgaaacggtaggggaaggcaagcttgttcatatgtatggtccttctgaaagcacgattttcactacgtattatcctgtgaatcaaattgagaaacaggcgttgtctatcccaatcggaaagccagtgagtcaaacggctgtttatattgtagatgaatttggacagctgcagccgccaggtgtagcgggagagctatgtgtcgctggggatggactggtcaaaggatattatggacagccagaactcacaagtgaaaaattcgtgaaaaaccctttccgccctggtgaggtcatgtataaaacgggtgatcttgcacgctggctgtcaaatggagagattgaattcattggacgaatcgatcatcaagtaaagattcgaggtcagcgtattgaacttggagaaattgagcatcagctgctttgccatccgcaattgaaggaagcagtcgtcattgcagccccaaatgacacattatgtgcattttttacagccgaagggtccgtctcattaactgatttgcgcgagcaggcaggacgtgaactgcctgtgtatatgatgccgtcattcttcatgcaattagacgagctgccgctgacgaataacggcaaggtagataggcgtgcgctgccagtgcctgacttaagtgagcaaggggtaaatgagtacatcccacctcaaacagaaacagagcgtcttgtagcgcgcatttgggaggaagttcttgaagcgccgcgaatcggtaggcacgatcatttctttgaatgcggtggccattcgctgcgcggcatgaaaatgctgaacaagttgtatgaagagatgcatgtggagctcactttgaagtctttatttgaatctccaacattagagacgtttgcctttgaggttgatcaagcggatcaaacggagatcaagcgggtggaggttgcagaagaagcggcctattatccagtgacatctgctcagaaaaggctgtttgtattggagaaaatgaccgatgcggagcaaagctatcatatgccggctgctttaaagcttgaaggtgcttttgatgaaaaacgatttaaaaaagcgattgaacagcttgtccatcgtcatgaagcatttagaacgagctttgattttgttcagaatgaacctgttcaacggattgaatcaaacatctccgtagacattgagacaatcgaagggaacggacgagacatacaggaattgatgaatgactttatccgtccatttgatatagaaaaggcgcctctactcagagtaggtctagtttctggttccgtaaatgtccattatttactgattgatatgcaccatatcatttcagatggtgcatctgtgggcattttaattgaggagctttcagccttgtatcgaggagacaaactagaggaattacctgttcaatataaggattatgcggtttggtcaaaaagcgaggcgtttgctgcacaaatagaagctgaagaggcgttttggctgaaacaattagaaggagaactgcctgtactggcactgccagaagatctgccaagaccaaaagtgcaaacattcgaaggagaccgcgtctcatttacaatcaatgggccacttaaagcgaaattggatgagctggtcagagcgctcaacagtacgacgtatacagtgctgctcacttgctacagcatccttttaagcaagctgtcaagacaagaagatatcatcatcggttcaccgattgtaggtagaactcatccggatattcaatctgtcattggtatgtttgtgaacacgctggcacttagaacaaagccagcaggacatctgacagcggcagaatttgcgtcaaatgttcatcagcttgtgttagaggcaaatgagcatcagttgtatccatttgaagaattggtagaccatgtgcaaacggttcgagatactagccgtcatccaatctttgatgtggtgttctcgatggaaaatgcagatatccgtgatttaacgatggacggacttcatattgttccgcagccattcgaagagaatatcgccaaatttgatttgaccttaactggaaaagaattagctgatcacattgagcttgtgttcgattttaattcttctatttttcaaaagtcgtcgatcgaaaagtggaaggtgtttttccttcatttattggaacaaatggtatcagcgccagatcaattgctggatcaaatgcagctattatcaccgaagcagcagcaaaaactgctcagtgaatggtcaggtcctgtactaaacgttccgtcagatcaaacggttcatgcactgattgaggctaaggcatacgagacgcctcatcaaaaagcggcgaccttctgcggaacgagctggacgtatgaagagctgaacaatcgggcaaatacagtcgcttcaaaactcatctcaaacggcataaaaggaggtggccgcgtcggcattctgacccgtccgtctcttgacatgacggcagctgtccttggcgttctcaaggcaggtgcggcattcgttccagttgatgcggattatccggatcagcgtattgcctatatgctggaagactgcggggcagaggttcttctgatgcaaaaagggctggctgcaccatcttcattcacaggtcatgttctattgatagaagatgcggtagaaggcgaagcacaagacattcatgttcatgtcaaaccaactgatctcgcctatatgatttacacgtctggaacgacaggacagccgaaaggtgtcatggttgagcaccagtcccttgtgaatctggcgttctggcacaatgatgctttccaagtgaccaatgcggatcgaaccgctaaatatgccggttcgacatatgaaatggagaaaatgtttaaacgggtgatgtgatcaaataaaaaaaagacaaagggccaaattagccctttgtcacagtctgaagcgctcttataagagcgcttttttatttagcatccgcacggattgggcggtgtgaccacaactggtcgtgtttgaatatcgagggtgtcctctgcataaaatttagaaccaatgctaagcgcacggttttctgcacggaacgtatatgtacctgcagcaggaagtactttatgtgaaagttgtaatttatattgtgagattcctaataaatcgattctagctggaatgcggacagtttttccactgttcaaaatgtagctgtcttttagtgcttttccattgaagatgtcttttgttgtcgcttgaaagcctgcaggtaatgtgaactcaatggcaccgatacttaaaacagaatttgggcggtatgttagctcaatgtctgaaaaagaccattcctgcttacttgtacctgtaattttcgcataaagctcagctggtctggcatttgttgatgctttgccttcctctgttttggctccttcagcggatgcggcaatcggtaccgatagtgccatgaccagtgtcagcatccccatcataatcattgtccatatttttttcatttcttcattcccccttgttgattataggtaaataatagatgattaaatccattatttacctataatgttaccatatccctacaaggtgttgaatggtatattatacccttattttgtcattttgtttagtaataacgggagaaatgcgtatttggttggttcattccgtaaccaaagcctggcatttgctgattcggcatcatcatatgcatatcttgatatccgtatggatgatatggcatcattccatatccaccatagtggccatgatgatggtgatccttcattggaacatgtgaaaagggatcatgctgatttggaaaaggcagataggctgaatgatgatgcggataatgtccgctgtacttatcttttttaccatgataatggtttggcatattcatatgatcatgcatgtttggcgcgaccacatgctcatggttggctgtatacacattctcaaacgtatggtacgggtttccttcgtgatgatgattcattgggctattcatattgttcatttgatatctcatcctttatgtcaggttgccatatcctatgagcatgatccgtttcatgagcctatccatatgaaaaaaaaaccggcttttcagccgggaaaacaaaaagcagatgaaagcgtcaggtgctaaaatgagatgctgtgtcttcttctgcgacgcttcttacagctgctacagacacttttaggacagtaatagggatcgtagcttctagaagtatcccagaaatcgctctcaaaccaatcatcttttttatgataagacttcttttctttacatggatcaacatggcgatgatcgtcatgctttttataacagtttgagtgggaatgtttgcacttgcatttgcacattgtcatccctcctaaatgtgactcaatgctagtatatgcgagaatgagacaaggggactggatggtggcgcatcttctgcaaaaaaaggctttttctaaaaaactcaaataaaaagaattgactagtgctaaaataacatgataaaatattaatttttatccaacgataaaatgtgttataatcatattgtgaatactttcggaggtggcggatttgtttcaaataggtgataaaattgtttatcctatgcatggtgccggtgtgattgaaggaatggaagaaaaagagattttaggtaagacggaggaatattttctgattcaaatgccaaatatgcagatgatgatcccaagaggcagaatcaatcaactaggtatacgtccggtagcagatcaagcaacgctgaaagttgtgatgaacaattttgcagaagaaacaaacgacgacacgcttacttggaagcaaagatatgatgaaaatctgaaaaagctaaaaacaggtgcgatcgaagacggtgcagacgttgtcaaagatctgatgagacgaaatcagaagaaagcattaaattcaagtgaaaagaagatgcttgaagatgcgcgaggcatgttagtgagtgaaatttctcttgcacaagggctgtcacaagatgaagtcctttcagctttagaggatgaactaagagtttaatgatggatatacaataattggctgtaaacagaagggcatcccttttgtttacggctttttttgtttgaaatcagaaaaacatcttcatttttgtgggtgattttaactaaaacgaaaatgaggtcatacgatgcagtttttatggaagaagcgaatgatgcaaagaagtcagaaatacctagaacggcataaaaaaacaggaaagttctcctgattcatttaaatgagccggacaacctttgaattctgttagccattgatagtaaaataatgcgataagatgacacctaagagaatgaaaaggagcggtgaaatgaaaaggctactgatatgtggattcatctttctgatcctgtgtgctcttttaatggtgaaatgcagccattctgttcaagaaaaaaaagagcaaaagcaacatcaagaagaggtagaaaagtatcaaaaagagcgaaaaaaaggggatcaatatgacagctttaaacagcttatccggcatgaaagagaaggctatgaaatagaatttcacgaaaagggcggaagtgatttacttgtcttttcacctcatggaggggaaattgaaccaggaacaagtgaaattgtagaagcatttcaacaaagatactcgacgtatttgtttgagggaacgaaacaagagaataatcgtgatttgcatattacaagcaccaagtttgatgaaccgatattggtccaaatgattaaaacgtaccccttctccatttccatccacggctacaaaagtgataaaaggcacacgctagttggcgggacaaacgaaaaaatgcaaagagcagttgtacgagaattaaaagatcgagggttttctgcagaaatggtgcaagaaggcgaacggctctcagggacagatcctaaaaatattaataatcgaaatgcaagtggtgaaagcgttcagttagaaattagtacggcacagagagaggcctttttcgacaattttgatacgagaaaaggaaagaaaaaagcattcagacgttatatccgtgctttaaaagaagtattaagagaatttgacccatcatcgtagaaaaatcgttttgatgggtaaaaatactctatttgaacttggtaaaaaagatagaaatatgcgaaatgaacttaaaatatgcaataaattacaatttgccttaaaaacataaattatgtaaaataatagttatcagtttgatatgatagaatggggctgaagtggatggcacataaaataccatcttccgaagtaggtgtaaagatcaatcaatggtacacgcatatttgcaaatttgaagtcgaacaagcaaacgatatgaagcgccttgttgaagaagaaattcatgagatggaagaggatcaagatttacttttatattattctctaatggattttcgccatcaactgatgcttcagcattcaacgccagtccatgcagggagtgaaacacttcaagccgtgtcttttccaaaagaaatggaagaaggagaagatgagatgacaggcttactcggctattactttcattttttccatggaatgtttgcgtttatccagcgccggtacatcgaggccatttcctattacaagcatgcggaacatcaactgatcttagtgacagatgagattgaaaaagcggaattttactataaaattgctgaagtatactatcatatgaaacaaacttatttctccatgcattatgctaaaaaagcaagagacatttataagaaacatcagctttatggaaaaagaagcattcaatgtgattttgtcatggcaggtaattggattgatgtgagtcagcaccagaaagcgcttccttacttagaaaaagcgttaaaggtctgtgaagcgatggagcagaaaaagtgcacatcttattttaaagcgatggcccttaataacttaggagcttgtcattatagtatgggaacgtaccatacagcgacagtcttttttgaacaagccatttccctttatcaaaaagatcaagcatccacgatgatcaaatcattattttcacttgctctcacctggtttaagctcggagatatcgagcgggcgggcgaggctatacgtaaagggatgaatgaggcttgtttattggaagatgaaatttatcagttgaaattccaatttttgcaggcgctttatatacaaaaagacagctgtgagcaattaagatcggcactttttggactgcgaagcaaaaaaatgtttgctgatttagaggaattagcacttgatgcggctaattattataaggaacgcgacatgtacaaggaatcctccactttttttgagattgtgatcgaagcgcgtacgcacattcaaaaaggagatgagatgtatgagaacgaagcataacatgtcagctgatcaagtagatgaaagacttcacacataataacagacaaaaacaacaccctttacgaatcaacgtaaagggctttttttacttattcttttatggctttttctgcgtcaatggcacctgccccgtaaatcatcaggtcatccccagaccacttgcttgtattttcttttaacagggttttgacctcattgggcgttacatctggtgaatgctctaataaaagagcacaaataccagcgcaaatcggtgttgccatagatgtgccagataacgtcgtgtaatcatcatcgactctgcttgatttatcgagtttatctagaaaggatcttggtgatctgagggagacaatgtttactcccggtgcaaggatatcaggctttgtctccccataaacagtaggacctctgcttgaaaatggtgccacaatatcatcgttcgattctggtgtattccggtcatcaaaagcgccaaccgtaatcactttttgactgacggcaggactcgcgatcgtttggctgttaggaccagagtttccggctgcgacgcatacaacaatgcctttatcccaagcggcattgacagcacgcaccatcggatcgtcctgttcgtcatcataacgctgagcatctgcgcctagtgacatactcataatatgaatcggatcatcagggtgatcttcattgaactggatgcaccattcaaccccttctattatagtagaaagtgatccagccccttgtttatttaatacttttacgccaattaaatgagcttttggagcaggtcctttgtacaagccatctgaggccgctccgtctccagctacatctccagcgcaatgagtgccatgcccgttatcatcataaggctttgttttctgcttgactaagtccacaaaatcgcgaattcttccttctagatcttcatgcggataaatccctgtatcaatgacagcgaccgtaatgccttcccctgttaaggctgtaccgtttcggatgacttcatccgcgtgactggcttgtgtggccacatccagaagtgcatgaactttccggtctaaataaattttacgaatatgctcaccatttgctaacagctcctctaaagcagctggtgttaggtctgcagcgcagcaatcaatatgtgaaaagtgccgtttgatatttgtttttctactttttttcatgagctgttttgtgctttgaatccctgcttcgaccgcgccttccttaaattcaataatcacacgaagcttctttctcttctttaatcttccttcaaagaaacgatgaagaaagcatggcgtccatttaaaaggcttataaaggtgaaggacggtctctcttaaaggttgatccagtttactagcatgtgttctgaccatttgcaccatagaaaatccaaacatgtgatgccctccattctagctatccattcttgtacactcttacgttatgagaatgagaggtgcttggttcggattcttgtcccttcttttcttcatattggcggcttactcatttctgatgaaaaagaaaagcgcttacattttgtaaaataatagaaaaaggtggaaaacatgtagaatcagccgatgataggtgggagagttcttcttagagaaccggtgaaacaaacgattttgcagaaaaaaaggagggggtagacagggtcaatgctcatacaaatttgacttgtcacagagaggaaaaatcaaatccatataaaaagtagccaaattaaagaaaacagactggatagaactaggtcattttaaacataacttcatttgtctgtcatactattctaactctgttttcaaagaggagaggcgtttctgtgtatataaatgcaattatcttatttttgaggaatctcatcaactagagtgttatgatcaaatttgaagagaaaaagtggaaaaaatgaaaagaaatgatgattcaatataaatcatagaaacggcttagaaatctgttaaaggagaacgggaatgaagaagttttttgctttgcttctcctgcttgcgatcggatggggcgtttattatacaatgcaagcacaggaacatgatgagccagtgtcatcaggtggggaagacgaaagcggttcaaatgatatttatcgcaattttaaagaactagaagaaaacgaatcaacaagcagctatcagattacatccaacccagtgcctggaagccgtcttcttgtgatgtcaccccatggggggagaattgaaggcggcgtgagcgagatcgtccatttttttgataatgatttctctacgtatttgtttgaaggtttaagagagaatgcgtcagaacttcatgtgacaagtacaaattttgatgagccagtcggcgtcgcgcaggcaaaagcacacgattatatcttagcagtgcatggctacaaaggtgaggaaggcattgaccatacactcgttggcggaacagattacgaccgtgcagagaaaatagtgaactcattagagcggaatggattttctgctgaactggctgtcgcacacgcaaccctgagtggaacaagcaatcataatattaataatcttacaaaaacagggcaaagtgtacagctagagattagtagaagtcagcgtgaagctttatttgacagttttgactttcggcggcggtcgagtacaaaaaacgagacgttctaccggtatgtcagggcgattcggacagtgcttgatgaggaatatacataaaaatggtgcacatgttaagacaagcagcgtgaattcttgttacactataaaaagtgataacaaaaggagagacgaatatggcgcgtcatcattttcatcttcgggcgagctggcctggcctgcgtaacggtgtgggtacaatctcatgcgaacagttaaaaacgaacatttcaattccaaaagaaatggatggtcccggcattgggacaaatccagatgagatgctcttaggtgcagcggctacgtgttatattattacacttgccgctatgatggagcggagccaattagaaaaagaggatctcacgatgagttctgaggctgtcgtcgatgtgacaaatggtgtgtttacatatgaaaaaatcatacatcggcctgtcatcatcctcaaagcctctgcttctccgcaagatattgagcttgcccgcaagcttgctcacaaagccgaaagctcatgtatgatctcaagagctgttcaaggaaatgtggacatttccttagaagaaaccattcaagtcggcgggtgaaaacaaaaagtcattttctcttaatgaaatggagaaaatgactttttttatgacgtccattcggtttgattgatatgttctttgttttcttccttttgtttttttgacaggttcaagacaatcacaccgcatattactaatgcaagaccaatgaagccttttatgtgaatggtttcgttaaatagcacgagtccgataagagcagtgagtgctgttccaacgccagaccatgtcgcataagcagacgaaaggtcaatcgttttaagtgctagactgaggaaggtaaaggcacacccaaatccaatcaggaccccaatactcggtaatagttgcgaaaaaccttgtgaaagcttcagcatcgtactgccaaaaacctccgttaaaatagcccctgttaaatagagcattcctttcatgatctctcacatcctttatgacatatttaaaagtacgacccctgagacaagcatagccatcccaatgattgctctttggttcaaggtttctttgaaaaaaagcacgccaaaaatagccgtgaggactgtaccaaccccagaccatgttgcgtaagacatgctaagtggaatgatatttagtgtcaatgacagcatataaaaggcaagtgtatacccagcaacaacgacagcgctaggcttaaagcgagtaaagccatttgagaattttaacatcacggcgccaatggcttctgaaaaaatggccacagctagaaaaagatatccgaggatcatcatgttccctcctctaataggtgtaaaatccggtgaagtaaaagggttttttcctctcggttcagcggttcaagctgaaacatttctgaaaaccatattccatcacatgcaagacggatcagctggctcaatgcagggtcattaatttcctcagctgctttcgctttgaactctgcataaaaatcacgccaagggttcaataacgcttcatcaaatgacatagtagccagcatacttgtacatagctgaatcgtattttgatgatcaagatcatgtaatgtggccgatatatatgcacggacataaggtgctttttcatgtttgtaagtttcttgatacgtttcgagctgctgacgaaagcaaagaatcgcgtgctcattcattttttggatgagctcttccttgcttgcgaaatgataaagcaggccggctttggtcatatgtgcatgctctgccacttgctgaagggtaagctggcttaatccttctactaaaatcgtgcgggcagctgcatcaaagatttgctcttttttggttttagacataaaaaaaaacacctactttactgaacggtcggtaaagtaaatgttaacccatcaaaaacgagtgtgtcaatcgattcatttgatgaacagattttttcgctaaatcgtcatatttaataataagggtatggtccatatggcgggtacggaggcggataagggtacccatagccatagcctggtgcaagcagagacccagcaagcagacctccagcaaaaccacctaaaaatggaggtccgaaaaatccaggtctaccataaccgaatccaggtctcccaaacccaaatccgggtctcccaaacccaaaacccgggcgtccaaagccaaaaccaaaaggtcttctcatgtcttcttgcataaatggctgtgcatcaaaataattcataaaaaaaggctcctctcacataaaatcactgtaactgacatcagtgtattcgattggcctatatgtgtttgggtgaacgcctattataaggaggaatgttaaaaatgggcctgtatccgtctgattgggctaaatgcccgccgcatgctcatgcctataaagcacgaacggatgtaacagaagagcattatcatttaatagaaggtatttctcagcctgtcaatggaagcagtaccgatcagcatactcattactatcgcggggtcacctcttttgagagaggacatttccacagatactacggcgtcacaggacctgcgataccgagattggatggtacgcactatcacgagattgaggaagtcacgttttctgcctataacgactctgtccctattccatacggaggagtcgtctatagtccggacgaggagcggccgacgcatgcgcatcgcttaaaaggaaagacgtacgaagtggtcggaaatgaaccactcggctggtgatagaccttatataggagagtaagagaagttatgctatactgtaggcagtttgtaaaagagagtgatgttatgaaaaaaacgaaacaaccagtgattgtattagtagggccgacggctgtcggcaaaacaaaactgagcattcatatagccaaagcatttaatggagaaattatcagtggtgattctatgcagatttataaaggaatggacattggaacagctaaaatcacccctgaagaaatggatgatgtcccgcaccacttaattgatattaaagagccagatgaatccttttctacagctgaatttcagcagctggtccgtatgaaaatcaaagagattgccgctagaggaaaaacacccatgatcgtcggcggaacaggtttgtatatccaatctgttttatatgattacacatttaccgatgagaaaagtgaccctgcttttagagaagaaatggcgctgtttgagcagcagcatggctcccttcagctgcacgaaaaactaaaggcagtagaccctgatgctgcaaaagccattcatccgaataatgtccgccgcgtcatccgggcgcttgaagtgatccatacaacaggtcagaaaatatcggaaatgcaaaatggtcatcaagaagttcctctttatgatacagccttcattgggctgaaaatggatcgagagcttttgtacgagcgcattcacaaaagaattgatatgatgatagatcaaggcttaattgaggaagtgagcgcactttatcaatctggcttgaaggattgtcaatcagttcaagcgattggttataaggagctgtatgcgtatttccaaggtgactactcacttgatgaagctatccagcaattaaagcaaaattcccgtagatatgcgaagcgtcagttcacgtggttccgtaataaaatggatgtcacttggttcgacatgacaccgccttgccacttttcagacaaaaaggaggaaattttcgcatatatagcaggaaagcttggacttaaagcgaaactgtagttatcagaatcaaggaggacgaaacatgaaaccgattaatattcaggaccaatttttgaatcaaattcgtaaagacaatacatttgtcacagtattcttactgaatggctttcagcttcgcggtcaagtgaaaggatttgacaatttcacggtgctgcttgaaacagaagggaagcagcagcttatttataaacatgctatttctacatttgcacctcaaaagaatgtaaatctagaattagaataggatatgttcgacctaatagccccatgcatctgcgaataaaccggctggaacccgctacgtttttgtcagtgcagaggggctattttgcatgccgtgaaacctttctgtctattttgcgtataatcccttattggatatgaagaaaggtgaggggaacgatatggaaaatgcagagcttgaattaagaaggattagagtgatccttctactaattgggattgttgtcttatttggatcgtgcgccatttcaaacattgaatctaggcaggaaagctggcataactattctaatcaagatgatcatggagatatagaaggtctgttacaatcagctgttgcactaaaaaataatcactttgctgttgtgaaagatgatgaagtacatgtgtaccggtttgatgaaaaagagggagaactgacccttattaaaacaaaatacatagatgagtgggacgaagattatgatgatgacgattctgtggaagagtaagcacgtaaatttacaaatgaatgtgaagtcgctacactataatcatgcattagacatctagacagaaaaggatgagttcatgacacacaaaattaaaattaatcattgggaacaaacttgtgaagacgactcctgcttcgaatatggaacaagtgtttctgtaaatgggaaagaattagtcagagaagcttcaatcgtctctgcgcttgaagcggtgctaaaagaattaggtgttgaagtggaaattacagaagtgtcagaagatttacagtgcgatgcctacaaaaaataaaacaaaaagtctagtctactaagcgattttttttcgtgttatgatagatttcggtttcagttgaatagagagtagagcagtctatttttagatcctgttctgctctatttatttgaacgtacgagttcggctatgaatgttcggccgggttggttgatttttttcgtttcgaacatctatatattgtgttttgaaaaaacatagtatactatatatagtgaataacgaaatgatcaacaatactaaaaactaggtcgtgatggaattgattcaaatcgtatttgattcaaaaacaggaaatgttcaacgctttttggacaagaccccctttacagacaaacgaaaattgactggagaagagtttttggatacgccgtttattctcgtcacctttacgacaggatttggacaagtccctagtaccactcaatcttttttagagaaaaatgctcaccttttactaggtgtagcggtgagtggaaacaaagtgtggggagataattttgccaaaagcgccgatacgatttctaaacaatatcaagttcctattttgcacacctttgaactaagcggaacaaaaagggatgttgaattgtttacacaggaggtagaaagaattgtcacaaaatcaggttccaaagtggatacaattaaataacgagattatgattcaaaaagaaggaaagtttcagttcgataaggacaaagaagctgtacatagttatttcgtagattatattaatcaaaacacagtcttctttcacaacttagaagagaagattgattacttaatagaaaacgactactatgaagaagaatttttaagacaatacagcatggcagatattaaagaggtattcgaagctgcatatgcgaagaaatttagattcccatcattcatgagtgcgtttaagttttacaatgactatgcactgaaaacaaatgataaaaagaaaatccttgaacgctatgaagaccgcatttcagttgtagcgcttttctttgcgggcggagataaagaaaaagcccttgagtttgtagaactgatgatcaatcaggaataccagccaagtacaccaacattcttaaacgctgggcgtaaaagacgcggtgagcttgtgagctgcttcttgcttgaagtgaatgactcattaaacgatatttcaagagcgattgatatttcaatgcagctttcaaaattaggcggcggcgtcagcttgaacttgtctaaacttcgtgcaaaaggcgaagcaatcaaagatgttgaaaacgcgacaaaaggtgtcgttggcgtgatgaagcttcttgataatgcattcagatatgcagatcaaatgggacaaagacaaggatcaggcagtgcgtacctcaatattttccacagagatattaatgatttcttagatactaaaaaaatctctgcagatgaagatgttcgcgtgaaaacattgtccatcggtgtcgtcatccccgataaatttatcgagcttgcaagagaagataaaacagcttacaccttctatccgcacacagtctataaagaatatggacagcatcttgatgagatggacatggaagaaatgtatgatgagcttgtagaaaacccgaaagtcaaaaaagaaaaagtcaatccgagaaagcttcttgaaaaattggctgttcttcgttcagaatcaggctatccatatatcatgttccaagataacgtgaatagagagcatgcattaaaccatatttcacgagtgaaattctcaaacctttgctcagaagtgcttcaagcttcagaggtctcttcttacgcggactatgatcaagaagatgaaattggtcttgatatttcttgtaaccttggctcattaaatatcatgaatgtcatgaaaaacaaatcgatcgaaaaaacggtcaaactagcaacagattcactaacgcttgtatctgaaacaacagatattcgcaatgcaccagctgttcgaaaagcgaacaaagcgatgaaatcaatcggacttggcgcgatgaaccttcacgggtatttggctcaaaaccaaatcgcctatgaaagtgaagaagcaagagacttcgcgaatacattctttatgatggtgaactactattcaattaaacgctcaagtgagcttgcaaaagaaaaaggagaaacattccatcgttatgaaggctctggctacgcaacgggcgagtacttcaataaatacgtggagaatgatttcacaccaaaaacagaaaaagcagcagcattatttgaaggcatgcatattccaacaaaagaagactgggcagcactcaaagactttgtagcggaaaatggcatgtaccatagctaccgcttatgtattgcaccaacaggttccatttcttatgtgcaatcggcaacagcttctgttatgccaattatggagcgtatcgaagaaagaacatacggcaacagcaaaacgtattacccaatgccaggtctttcagcgcaaaactggttcttctataaagaagcgtacgatatggatatgtttaaagtggtcgatatgatcgcaacgattcagcagcacgttgatcaaggaatcagctttacactattcctgaaagatacgatgacaacgcgtgacttaaaccgcatcgatctgtatgcacaccataaaggcattaagacactttattatgcaagaacgaaggatacagggcaggaaggctgtctttcttgtgttgtttgattaaaggagagtttaacgtgacaaaaatttatgatgcagccaactggtcaaaacacgaagacgattttacacaaatgttttacaaccaaaatgtgaagcagttctggcttccggaagagatttccttaaatggggatctattgacatggaaatatttaggtgaaaaagagcaagatacgtacatgaaggtacttgctggactgactttacttgatacagaacaaggaaatacagggatgccgatagtggctgaacatgtagaaggtcatcagcgtaaagcggtattaaactttatggcgatgatggaaaatgcggtacatgcgaaatcatactcaaatatcttcatgacactcgcaccaactgaaacgatcagtgaagtgtttgaatgggtgaagaagaataaattcttgcaaaagaaagcagatatgattgtcagtttataccgttcaattcaaaaggacgatccgatttctctctttaaagcaatggttgcttctgtttatttagaaagtttcctattttacagtggtttttactacccgctttatttctatggacaaggtaagctcatgcaaagtggtgaaatcatcaacttgattttgcgtgatgaagcgattcatggtgtatacgttggactattagcacaagaaatttacaacaaacaaacacctgacgtgcaaaaagagctatatgatttctcaattgacctattgaacgagctttatgaaaatgaacttcattacacggaagatatatatgaccaagtcaatttatcgcatgatgtgaaaaagttcattcgttacaatgccaataaagcgttaatgaaccttggatttgccccttactttgaagaagaagagatcaatccaattgtattgaacggactcaatacaaaaacaaaatcgcatgacttcttctcaatgaaagggaacggctacaaaaaagcgacagttgagccgttaaaagatgacgatttcttctttggggatgaatcataagtaaggcgtaaaagtcaaaacgcatcactcgttttggctttttgccatttcatacaatgcgttacatactggaggttaccgaacatgggaaaaatggatgaaatcatactagttgcaccgcgcacacgcgtattccaaaacgaaacgcttgcgtttaatggtgtgaatagtgaagagaaaacaatcaatacaatgatgaaagaaatcgaagagcacttcgagcagatgcgcagaggcgatgcggaagaaaatcctgacttcaagcagccgattccttatgtcgtgattaaacgtgaagacgaagtgtatgtatatgaaaggcttcaaggcgggggagagactcgattgcatcataagttatctcttggctttggtggtcacatgaatttcatcgaaggtaaaaactttgctgaaattctaaaagaaaatacggatcgtgagctagacgaggaactttctattcaagaagaagacaaacttgagatgaaaacccttggattaattaatgatgatgacaacagtgtaggccgtgtgcacattggactgttatcagcgcttgaattatctccaggtgctcatgtagaagtgaaagaaacagatcaaatatcaggaaaatggatgaaagcatctgatttgaaaaagcctgaatacttcaatcgacttgaaacgtggtctcaatttgtcgtgaacattttagcataaatgaagcaatcaaaaaccggctcagcagcagacttgagccggtttatttcgttataacagcttcagttattggaaaacgaatgcgtcgtgacctgcctgtttcaattttgcaacgaggtcatccgcattttgctttgtacgaaaagctccggcttgtactcggaacatgccgccctctaatacaacgaaggcgtcaaagcctttggatttcagtgtggctgctaactcatctgcattggctttcaccttgaaagctccagcctgtactttataaagattacttgctttttctttcagctgaaaggctttctctaatccagtggcatgagcgtgagcgatgccttgaaggaaggtcgcgttacgaagcttatttgcatcagctgtcgtgtcaatgaaaccattctctgttaaaatagcgggcatagaagtttctcgaagaacgtggaagttcgctgttttcttgccgcggttggcaaaatccactgagcgaacaatctcatcatgaagggcattgcgatacgtggtggtcggtgctgaaacgccaggatacacatagctttcaaaacctgtgcccccgcctgcattaatatgaatagatacgaaatagtcagctccccagctgtttgctgcattagtacgctgggtcaaagtgacggattggtcaattgaacgacttaagcggacggaaacatcatcataatcactaatcaacatatctctcaataaaatcgcgatttgcagggtgatatttttctccaaaagtccattcgcagcagctccagaatctgttcctccatggccaggatcaataaaaattttcaccatctattcatcacctcgtctttattttatgagaaattagaaaaattgcctgtacaaaatgcggaaatcattgagactcttttctgcacaatttgtgatgagaaagctacatttttctaagaaaaaacaaattgttggtttgtccgcctaaatgggatgaatacaatggaaatagcacatcatttcctgggaaaccgcagaaatccctacaatattcggtatctcgggtcattttgacagcaaacttgggcttaagcgggcgattgtcacgattacagctccacccgaatagaataaagagagaagagcgagaggtgaatacgttggagcgagctgtcacatataaaaacaacggccaaatcaatattatacttaacggacaaaagcaagtattggttgatgcagattcagaggcagaataccttgaagccttgcagaaaaatgaggcgaaacacagcatcttacgggaaatagaacgtgaaatgaacagccttgtcggtatggatgaaatgaaacgaaacataaaagaaatttatgcttggatctttgtcaatcaaaaaaggcaggaacaagggttaaaggtaggtaaacaagcgcttcatatgatgttcaaaggaaatccaggcacagggaaaacaacggttgcaaggcttgtcgggaaacttttctttgaaatgaatgtcctttcaaagggtcacttaattgaagcggaacgcggagatctagtcggggagtacatcggtcatactgctcaaaaaacaagagacttaattaaaaaatcactaggtggcattttgttcatcgacgaagcctattctcttgcccgcggaggcgaaaaggattttgggaaagaagcgattgataccctagtaaagcatatggaggataaacagcacgaattcattcttattcttgctggctactccaaggaaatggatcattttctatcattaaatcccggcctgcaatccagatttccaatcaatatcagctttcctgattataccgtcgatcagctcatggacattgccaaacgaatgatggctgacagagaatatatatttactcaagaagctgaatggaaactgcgagattacttaatgcacattaaaagcaccacgagtcctgcaaaattcagcaacggccgctttgtgcgaaacacgattgaaaaggccattcggacccaagccatgagactcctgcttgtggatcattatgataaaaaagatttgctgacgattaaaagtcacgatctccaaatgaaagaggatacgcctacttaaaatggcgtatcctttttataaagagatactaaaataaaccatccgaatagtggtatacgtgtgatgtgtttggtatgatggtactactgaaaacttaagtacagaaaggaaacaactgacgttgaatgaacatgaaatgacagaaaaagcgatccttgtcggctgtcaattgccgcatgtcacggatgaacgctttcaatactcaatggaagaattagcttccttaaccaaaacggctggcggtgaagctgtcagcgtaatgacgcagaagagaaatagacaagacagcgcaacatatataggtaaagggaaagtggaagagcttgaagtgctttgtgaggaatttgaatgtgatgtcattatttttaacgacgaactgtctccaagtcagctaaaagctttggcaactgccttagatgtgaaaattatcgatcggacacaattgatattagacatctttgcaaaaagagcccggacaagagaggggaagctgcaaatagagcttgcccagcttcagtatgccttgccgagactaagcggacaagggatcagcctctcaagacaaggcggcggaattggcgcaagaggtccaggtgaaacaaaacttgaaacagatagacgccatattcgaaaccgtattcacgaaattaacgggcaattatctacagtcaaagaacaccggacaagataccgggaacgccggaagaaaaatggtgtgttccaaattgccattgttgggtatacgaatgccggaaaatctactttgtttaaccaattaacagatgcagatagtcatgaagaggatctgctgtttgcgacccttgacccaatgacacgtaagatgacattagcatctggctatagtgtgctgatttcagacaccgttggttttatccaagacctcccaacaacactcattgcggcatttcgttccactcttgaagaagtgaaggaagctgattatttgcttcacgtcattgattcttctaatgaggattacgaaggacacgaacgaacggttcatgagttattagaagaactagaagcagaccgtataccgatgctgacggtttataacaaagaagatcaaatcagaccggatttcatcccatcttcaaagcatcgtcatcttttaatcagtgcgagacgcgaagaagatataaagcgattaaaagcggatattatggcagaactgaaacaaaactttttaaaaccatatcatgtgaagattccagcgtatgaaggaaagctcatctccgcattaaaatcagaaacgctcgtggaatcactagaatttcaaaaagaagcagaactttatgacatcaccgggtttagcggtgaggagcagaccatattaggtcaaatcaagaagtatatgttgtaagaaaggaattaaatcaagatgtttcatacattaaaacacggcagtattttagaaaaagtagcagcagaaacagaacaagagattttacacatgcatcagcaaattgatcaaaagagtgaacaaaatgagtggcgggtgcttgaaagctaccgaaagcatagagtcagtgactctcactttaacccgacaactggatatggctacgatgatatgggaagagacacgctagaaaaaatttatgcggatgtcttcggaggagaaagcggccttgtgcgtccacagatcatttccggcacacatgccatttccattgcattattcggtgtgctgagacctggcgatgagttgatctatatgacgggaaaaccatacgatacgctagaagaaattgtggggattcgcggcaaagaagggacaggctcattaaaagacttccagattgattacaaggccattgatttaaggcaagatggatccgtcgattatgacaaagtaaaagagtcaatctcctctaaaacaaaaatgatcggcattcagcgttcgaaaggctatgcgtcaagaccttcttttacaatagaagaaattgagcaaatgatttcatttgtaaaagagatcaatgaagaaattattgtgtttgtggacaactgttatggtgaatttactgaattgcaagagccatgtcatgtgggagcggatcttatggcgggttcccttattaaaaacccaggcggcgggcttgccaaaacaggcggttacatcgttggaaaagaaaaatgggtagaagcttgctcttatcgaatgacatctccgggcatcggcagtgaagcgggtgcctcgctttatgcgcttcaggagatgtatcaaggatttttcttagcaccgcatgttgtggcgcaaagcttaaaaggtgcagtgttcacggctcgttttcttgagaagctcggattccaaacgaacccagcgtggaatgcgaaaagaacagatttaattcaatctgtcgaatttggagatcctaaaaagatgattgcattctgccaagcgattcaatatgcatctccgatcaacagtcacgtcacgccgcatgcaagctatatgccaggatacgaggatgatgtcattatggcagcgggcaccttcgtccaaggagctagtatcgaattgtcagccgatggaccgatcagaccgccttatacagcctacgttcaaggcggactcacatatgcccatgtgaaaaatgcgatttgtagtgctgtagatgccttattggaacaaggtttcatcgacatacctgctcaataaaaaaaccatgttaatattcctaacatgttgttgacacataatataacatgacatataataaatttaagcaaagaggaggagacagttgagatgagtgataacattcgccgctcaatgcctttattcccaattgggattgtcatgcagttaacagaattatctgcaaggcaaattcgctattatgaggaaaatggattagtatttccagcaagaagtgatgggaatcgccgattattttctttccatgatgttgataaattactagaaattaaaaacctcatcgaacaaggtgtaaacatggcaggaatcaaaaaactttttgccaaagctgaggcagaacatccatcttctgatgtaaagaccgaggagaaaaccacagcgaagcacaacttgacagatgatgaactcaggaagctactgaagaaggaactcattcaggctggacgtttccaacaaggaacgacctttaggcagggggatatgtcaaggttcttccgttaaccaattagcaaaagcattgctatacaattttaccttttgtaggggaggagttttacgaaatggcaaaatacacaagagaagatatcgtaaaattagtaaatgaggaaaacgtaaagtacatccgtctgcaatttacagacattctcggaacgattaaaaatgttgagattcctgtgagccagttagaaaaagctctcgataacaaatgtatgtttgacggttcatctattgaaggcttcgtacgtattgaagaatcagatatgtatctatacccagatctcaacacatttgttattttcccttggacagctgaaaaaggtaaagttgcacgctttatttgtgacatttacaagccggacgggacgccatttgatggagacccgcgtaataacttaaagcgtgttttaaaggaaatggaagacctaggatttagtgatttcaaccttggacctgagccagaattcttcttatttaaattagatgaaaaaggcgagccaacgcttgaactaaacgataaaggtggatactttgaccttgcaccaacagatctaggtgaaaactgccgccgtgatatcgtgcttgagcttgaagaaatgggctttgaaattgaagcgtctcaccacgaagtagcacctggacagcatgaaattgacttcaaatatgcaggcgccatccgttcttgtgatgacattcaaacattcaaacttgttgttaaaacgattgcgagaaagcacggacttcatgcgacattcatgccaaaaccattgttcggtgtaaacggatctggtatgcactgtaacctatcattattcaaaaatggcaaaaacgcattctttgatgaaaaagcagatttacaattaagcgagacggctagacactttatcgcaggtatcgttaagcatgcaactagctttacggcggtcacaaacccaacggtgaactcttacaagcgtcttgtacctggttatgaagcaccttgctacgtggcatggagtgcacaaaaccgtagcccattaatccgtatccctgcatcacgcggcatcagcacacgtgtagaagtgcgcagcgtagacccatctgcaaacccataccttgcactaagcgtattacttgcagcaggtcttgacggaatcaaaaacaaactagacgcaccagcaccaatcgacagaaacatctatgtcatggacaaagaagagcgtcttgaaaacggcatctctgatctgcctgcaacacttgcagaagcacttgagctgctcaagtcaaacgaagttatggtcaacgcactaggcgatcacttattcgagcacttcatcgaatcaaaagaaatcgaatgggatatgttccgcacccaagtacacccatgggaacgcgatcagtatatgtctcagtattaataaagaaaccccttggagccattggcttcagggggtttttaaaaaggatttggtggtcaaatttatagtgaccagaatcaaaatgaagattgaccactttttgaccaccaaattcaacagaaaatttcaaaagcaaacaaaacttttagatcaaataaatcgatattcactccatgactgtgagttcggtaaatcaaaagttaaataacttagtgaacagatgcaaaatgaacagcttgttttagataaattcctaaaagatcgtgaaaactccaagcgtaaagaagcgctgcaatatcagcttgaaaaagtcggaaaatcaattaacgcaaagtatgatgatcttattaatgctgagcatgggttcaaggatttagaaggcggcagacgaaaagaagaacgtatcagccactattgcttttattacaaatattcgtcataaagatcgagatcgcttttatcaaaatgctgaggaaaatttatataaattgatagaacctatgtattttaagatgaataatataaaaaatataaaagatgatcaccataaggttgaatctataagaaagtttttcaatacttataatcctgaaaaaataaatgtttcaaagcttggaaatagaaaattaataaacagatttagagaaacacattcagcttacagtcactatctaaccgaatttcatgatcaaagtaagaaattcttatttcttaaagttaaaagtttggaatattttttagataaatagtattggaagctctttgaagctatatataaggatcacgattatttcaagagaactgtcgacatgaattatctgttccgctttttttatagaatctctatttttattgaaagtacgttctttgctattagctggaaagtagttgcagttatcatttttgcaatgatggatgaattttcaaaggaaagcatatggattgaagattttaaactaaaggtactatatctactattgtttttctgtatttcgcaattgattctatatatatcttcgatgagtaacttggctgttgcagatgacataaaacaaaagaaaactttctacgattatttaatactgtgcttaacttatttgtggaaaaaggcttcattgaaatgtcgagagctaaaaagagagaaggctattcgtgaagaagaaagggaaagcatggagctcttagaagaaaacgatgaaactgaaactgaaagagggtgaaaatatgccacgagaattgataaatgcaaaaatcacacacgtttcatacgtgaacaaggctgctaatcaaaagcagttcttttttatgaaatcagaaaagcagccagactttcaaaaagaaatcaaggtcattgccaaagcagatgatgcacagcatcttgtgtacgttattgtatacaaaccaaacgtagcagatgaactggggattacatgacgccggcggagattgaaaaagccgctcatgggttcctgaaggatgcacgtgagatcgacaagcagcatgatttccaaggcggtgtcggggaagtcgttgaatcgtacattgctccgtctgactttgaaatgggcgatgagctgatcaagaaaggatcgtgggtccttgtgacaaaggcttctgatgaaatctgggaacagattcaaaagggtgagatcaacagatactcaatggccggaacagcggatataggtaagcaacagcgtgagctctagcggaggtttactactacctggataaagaagcaaaaaacaacggtgttgatggatactgtggaccaaaaacagcaaattcaataaaacgattctaattgatgcatggtcttgctactgacggtatttatggaccgaagacaaaaccaggtcttcaaaaagcattgaaataagtaaaaccactgtcctttttaggatggggaatttttttgttcgttgattagtaacatcgaacaagtaaactttctaaaatattgttaaatatctaaagcattttcaccaattaaaaacatacatatacctatataaattcaagatttttattgttaaaataaggtttaataagcaatatcctagtgtaattactttttttaacaaaaatatttaaaatgttctctttgcctgagataatcaaataaaatgaatagtgacagggggtgtatgtttgccggaaaaagttgaaaattcatttgtttaaatcccttttgattaattcgacctaatgaatatattgtcttttataccataatattctataataatatataaatgtagaatatagacctacaagatcgttaaagtgttgattatcaaattacgagtccgggtcgtaattttttaataatacaattcaaaggggaaacaaaatgaagagatttataacaagtttgaaagtctttgttgctgtcttattattgtttgcgatcacacccattgtagcaaccgcagaagaaactaacgatcaggatttaacgtttcaaaaagcaacggatattgtaacaaatgaagacatagaaaactacaaggctttaagtgaagaagagatcattgatcgaaagacagcgattagtgagggttatgctgaaggtgatgttttatcaaaagaagatgccttatttttactaactgaatcaattgttgaacgtcaagatcaaaacggagagctttcaactctagctggtaaatcatcaagaagttttagtacctcaagaaagaaatatggaacaaaagtaactttaaaaggcacaatgtatcaaaatattgcgttcgttgcaggaacatcatcgtttcgtggaaatattaaagcaacacgaaacagtgggaagctcaagcagatcaccctacttacttaccatgattcattcggtgtcgtaggatggaacggagggtggccatctgttggtaaagtatatggtggaaaagtcagtaataaaaaagttgccaatgccaaaacatatgcaatggataaaacgcatcgttacaattccgttttgcctgtctacaccactatgtggccaaaggcagctgtgaaaacaaagtcaggaaatgcctatgatgtagcttctaaaacttggactagatggcactaatccttaatgaaaggagatagtaaatatgccttggaatacaattatcactgccggtctatttgttgtgatacctgtagtcattatcacagtagtagtttactttattaaaagaaagaacaccaaaacatctaatagttgattactttaaaagagccgttcattttaattcggctcttttttatattagctattcaaaattgctccccaataaggctttactatatcaaaacgccctaacttttgcggtttctttttcggtgtggaattatttcttaaatgacaatatatttcattatagggaatattaaggaaggggtagggtcttatggagaaagtgctttcttctcatgtcgggttgaaaatcaatgaatggtattaccatattcaaagatttaacgtttcggatgccgaagcgtataaggaagaaataaaatctttgctcgataatatgaaggaaaaccaggatttattattatattactctcttatggaattccgacataaattaatgttggattatttgaatccattggaaaatggaaaagagcgtgccaattttagggatttagcaatgaagattaaaaaggatcaagagaaattaacaggcttgcttgattattattttaactttttctacggcatgtacgaatttgaaaactatgaatacctcaacgccattacattctacaaacgagcagaaaaaaagctatctcttgtaagtgatgatattgaacgtgccgaatttaattacaagatggctgaaatctattaccacatgaaacaaaaccacatgtccatgcaccatatagcccaagcaatagaatgttatcgtgaaaaagatacttatactgttagacagatacagtgttcctttgtcattggattaaactatattgatatgggctgccccgaaaaagcaaagcctcattttgaacacgcactagaaaaagcaacggatagcgacaccaaaagattagaaggatcagcgctgtataacttaggattaagctatttccacaatgatgaaatagctgctgtaataaaatatataaatgactcgatcaacgcttttaaagaacgaggatatgagcattttaacagaatacttgatcctttaagtatgcttgtaaggtcatattttcaatctcatgaaaacgatctaggcatatacgctctcaaccagggcatagaattggctgaaaaattaaatgatgacgtgatgcttaaagtattcactttttacaaggcgctttatgtgaaggaagattatgataaagtgttgagtgataccgaatatttaaccgaaagaggaatgtatgcaattcttgaagaattatcgaaagatgcagctagaaggtataaaacagtaggagataaagacaaggcgtcgaacttctatgagaaggttctttacttccaacaattaataaaaaggagtagttgcaaccctcatcattattggcactttgagcacgcttggttatttcgtcttttcacaaaaccatgaagaagctatcagaggacacacatcaagtatcggttatgataaattccattagaaaaaagccctttttagggggcttcttttttatttgaacattatttttctaaaatccttgaatctacaatcctttttcttttccccgttgctttattgaatgattcaaggatatacaaaaatgtgttgtcggtacatggtttaacattaattatgttttccctactgttgtaattggttaaaaaacgataaagtggattaaagtgtcaggctccttatggtattctagtaaaagaatattccataaaaggagtcttttttatatgaaaatattagatgctccatctttactttcagctgtcgaacagaggtcaaaggcctatcatgagcttcaagaagagatgaaacttgtgaaaaaagcattaaaaggtgtatcgggattaggtgatgggtttactggaaaaggtgcagataatatcaaagctttttataatgatcttgcactatacacagacacttatcttgattttatcgatatgcaaaaggcttttttagatggagtgaaaggaaagctggatgatgaatcattaggcgggagtacatttattgatgaacacttcctagatgctcaattgaagcaaggcattcagaacaataaagatatggtcaaggaacaaaaagaagctctatcaacgatttttgacgatattagtgatttgattgaattacagacattttccagcaaaaaagtagacgagcatttagatgatgcgaataaaaaaagaaaagatgcaattgaggctatacatacattagatcatgttctaaaaacagaatacgaaaaatcagaagccattgagaaacatcttgctactttttatacaaaaatgatggctgctacaggaaaaggtaagaacgctcagcccatgtattatgatgcaaaagcatttcacgagacagatgtgtacaagaatcatgataaaattgatgcacaggtgaaagcttacttaaaagtgaaaaaagaagaaaaagagaaacgaagaatcaaagaattgaaggaaaagctcaatgatccttcgtgtatatcagtagagaaatactttgagattgtagacgaaattggatatgaaaatctttcttacgatcaaaaattgtattacagtcagcttctccagatcaaagcgcaggaagaagcatcagaggtattcgttgacagtgtaaaaggtgctgcagttggtctatatgatgtggcaaaagatacagtggttggcatctatgatcttgtaacagaccctgggggtgccgttgaatcggtcgtaacagctgtttcacacccaattgaaacatcgaaagcgattggaaaagccatttcagactcattcgaaaaagaagtcatagatggtgatgcgtattcacggtcacactggttcgcctatgcgacgggttcactagcagaaattgtctttggttctaaagggacaggagccatcacaaaaacggggacaacggcggcgaaaactacagtgaagaaagggcttgaacaaggagcaaaatcattagacagagtttctattccgaatctattgccatactcacctaagtttcaaatggctggtagcccgaagctgccgtataacgtgtttgacggagaaaatcttaaaaataaactcctctccatggcaaagcgtctagacaacaattcaggatacggaatctctaagacaggcagacgcttaccagcacctaaatcaccaccgaccgttgtcagttacggagatcactatgtgagatggaaacgtaagaaagtattaaagcctaatgtcgtttattcaactaaacaaggttacacctacacaaccgatcactacggaagaattgtcaaagtcgaagcaagtgatttaaaatacggagaggtcaaaagaaaccaatatgcccaatccaattcaggaaagccggatcgattatcaaaagatgacggaggtcacttgattgcctctatttttaaagggtctggggatattgataaccttgttccgatgagttcacagataaatagaagtggcgggaaatggtatgagatggagcaacggtggttgaaagctttgaaaaccgatccacctaaaactgtgacagtttcaataaaagcattttatgaatccgattcgttaaggccatctgaattcctagtcaaatacaagatagacggaagagtttatacagacacaatatataacagaccaggaggatgaacaaatggaaacaaaagagatggaaagcttatatagagaaatagctagaaatttaaatgaaatgattccagtggaatgggatacaatttggatgtatgcagaaatgttagatgactccgcatctgctctcttttattttacggttcctaataaagaggaatatttttattcacacaatatcccagatcaatatcaggttagtgaagacacatatgatagcctgttgattaacttacaaagaaagctaagacagttgagggaagagtatactaaagaacaatcagataaatggacaaccgtaaaaatgaaattgacttattcaggaaaaatgtcaacagattttggttacgatgatgtattttctttaggtattgacaatatacagagaatagcagtttgggaatatgaaacgtttggatttttacccgatgatgaggaagataaagaagctgtgctaaattttataaaaaataaagaagaaaacaaatagtacattaccctccaaagacaggagggtttttgtattagatatgaattggttctagaaaaagtagactaagaggatacaacttgttcagactgatttgtataaaaatgtgccacatattggtgcagcatcagacttaagaggaggctactaaaaagagttttaaacggattaaagacaaacttgatcaatacactattgatatcagatcaaccaaaacaaatagctcattatacgaaatgaataaaatagaagaagaaaacggatatcacatttcttctgattataaaagttttattaataaatatggagaatgttggattgaggacaatgtatatacctctctaagagaaaaaccagtgtggtttgttggtgaatcagtgccagtcgaattgttttatgggttggagcaaaatgattatgatataagagaagccataaaaacatataaagaacaattatcagaacaaataattcctatcgcagacgcagacgacggagacctaatttgtttagatgttagtgaaataaatcaagggaaaatttatttttgggatcatgaacttagagatagagaccaggatctgttcctgattgctgatacttttactgagtttattgaagggttatttgttgttgaagatgatcatgaagatagtgatacagaagatattgctatccaacttagtgacgatctcataaaaatgttaaaggagagagattaaaatttagacaaatcctttcaagaaaactaaacgtttctcctatctatatggaaattcattttaatctgaataacttttaagtttaaagggtgctaaagtgcatcctttttttttttttttaaaaacactctttatgggtgttttagtttgtattagctataggatgtaatgcatgattatgatcatctagaagataatcaggatgcgcttttaacattgtatatttaattgttttatcaggattacccacgaagtattatgtcatcaaagggaaggctttttattatggtgatgcatattctcgatcacactggtttgcctatgcaactggttctctagcagaaatcgtctttgggtctaaaggggcaggtgccattacaaaaacgggaacaactgcagctaaaacaacggtgaagaaagggctggaacaaggagcaagatcgataacgtcaccattccaaatctattgccatattcaccaaagtttcaactagcaggtggagggaaactgccttataatgtgtttgatggtgagaatatcaaaaataagcttctctccatggcaaagcgactagacaattcagaaggtaatggaggtcatttgacctcatctaataaaggatataagggtatagacaatgctaatgatataaccaaattaactgtcgatgatataccaactgcaaaaagtgggaactttaataaatttttcaattcccttacaagtaaagaactagacgaactttggaaagataaaagaattagaaagaaaatagaacgtcagcttagagaacctggaggtttacatgagtggcacttagtttcaagagcgccgcaatttaagcattggaatattagtgctgaagagattaaagatttacgaacagcaatatctgatattaaattcgtcaatccaaacggtgtccatggtggattaggctcaactaaggcacataatgaattgttagcaataatagatacttctagcgactatgatacatttgtaagacgacttaataattgggctaattatagactagagggtggggtttcatctttaccggaaggtcttaaattaaagtaggaggatattaaaatgaaaaaaaaaggattggtttctatttggctaggtactattaaaaaaggggactctatagaagagtatgtagatttaaagtatgatgaggatggcgagtctgtaccttccaaattttttattgattttaatattgatatggatgaaacagatgaggatacaatagaaaaagcagtctataagaatagtagtagtgatatttcatcattattagatgggtgttcgtatgaagagattgtcatcccaaaaatccagaaaagtataaacctaaagaaatcatataacgcagtaattttaatatataattttgaatataacaatgaaattagttcaactggtgcttttgattttattgctactacaaattatgaataagagaacccttaaaggttctgattagcaagactacaggcaaagagattgatataatgtaatttatgtgaaaccttgattggcaaagtgcctttcaaggtttttttgttgaagagatacctagtgactaatgaactatttattacttacaaaatagagataatctttgcaatcccaatctgatgttttaacaaaatttttagtacgtacaacaccttttaattgtatgccctatttaatgaatttcttaaaaattgtcatatactaccatttttattcccgaatattttaccatccctttctccctgccttttaaatttttctcaacttttacgaacgatcactatggacggattgctaaaatcgaagcaagtgatttaaaatacggagaggtcaaaagaaaccaatatgcccaatccaattcaggaaagccggaccgattactagatgatgacggaggtcatttaattgcgtctatttttaaaggatcaggcgatattgataacctacttccaatgaattcacagattaatcgaagcggcgggaaatggtacaccatggagcaacggtggttgaaagctttgaattcaaacccacctaaacaagtagcagtgaacattgaacctatctataagggagattcattacgacctgttagtttctctgtggagtataaaattggagaacgttattctcaagtatttattaagaatcaacctggaggttaaaacccaatggaagaattagaaataaattataaaaaaatagcagaatcaattaatgaattaataccatgtgattgggataaagtttggatgtatgcagaaatacttgatgattcagcaggaattactttttactttactgaatctaatagtgaagagtatatttatggacacgatattcccgaacgatatagagtaagtaattctatttataatcatttactagtcgaacttagtgataaatttagagaattgaaaaaggaatatataaaatatgatttaggagtttggactacagcgactcttcagttagagtcatcaggaaaatttactattgagtatggatatgatgatgtttattcattaggcatagacaatgtgcaaagaatcgcagtttgggaatatgaaacgttcggatttttacccgacgatgaggaagataaagaagccgtattaaattatataaaaaataaagacgataactaacgcacaataccctccgatttaaagagggtatttgtcatatatgtttcaaaaaacctcatttcctttatttaaaccgataaaccgtcacttcacaatcacccagtacctcttcaatcatctcttcaacaatcatccaatcgccgccagccaatccgcagccgattccatatggaatggcgatggacgtttggtttttctcctcaggtgattgtgtcactgtatcctttaagtgttgaaagcagctgcgtaaggcatcgtagtctgtttgctgtcttgttcttccgtatccaacttgggcaaataagttggcaattgtttttccgtcttttgttggggtgagttgaacggagcttaacaagtcatctccttgttctgtacataattgtttataatctttgtacacattcggatatttgcttttgatctgtttcgctaatccagcgcccatgactcctttacagttcacctggtgacagatgatgtcttcgcttgcctctaaaatgttgccatccaccgttttgatcatatgatgtaacccctttttgataaaatgcaaacctatgttctattataacagttgtgatcatgatatttaagagccaaaatgcttttgatgggtttatttaaagacacttcaacatgatctgattgtcaaagttgatacatgtcatctagaatatggagagactgcaaacgcgaaatcaagcagaaacagtgaggggtacaatatgaatctattagaaacgaaccggttaatgattagaccgttttgcgatgaagatgccgcaggaatgctagagtacttggctcatccaagagtcaattgttttcttgatgatcgaatctctacattggaggaagcggctgctaaggtgcaaaagagaaaagaagattactcatatgtagcagtttgtttaaaagaaagtgggcaggttattggtgaattgtttcatttaaaagaagagcctgatacgtattcaattggatggaattttaatgcagcgtatgaaggaaagggatatgcacgagagagtgctgaggcattattgtcctatttatttgaagaaaaggcagcaaggcggctttatgcctatgtagaagatgataatgtccgttcacaggcattatgtgagcgactaggcatgcggagagaagggctgtttcttgagtttatttcatttactacatatgaggatggcacccctaaatatgaaaacacgtaccaatatgctttactaaaaaaggaatgggagcagcatcactctctatagagcagtaagtgaatgatcttcagtgacagcaaagtgacaaacatgtcatatgattccatggtttgttcgttcaatcgatggaggagtcatcttatttcatttatccttgtcataaatcgaggaaaaagggatgaaatgagatgcagggatataatgaagatttatttaggtgggtgaatcagctcagtatcgatcatggttatttgaatccgatattcattggactagctgaatatattgtgctgttagcagcactcacgtgtctgttcatatggtttcaaaatcgaagtagaaccaataggggcatggttgtatctgctggacttactttcatattggcagagttaatgggaaaaattgcaggtgttttttattccaaccagcagccctttgccgaaatgagtcatgtcaatcttttgatttcaaaggaagtgaataactcttttccgagtgatcataccatctttattttttctgtttgtctgatcttttggctttttcacaaacgccatgtttattggctgttcatagcatgcgccgttggtttttcaagaatttgggtaggtgtccattatccatttgatgtcttagcaggtgctgccatagcgagtttaacagcggtcactgttgtctatttgccgatatgccaaaggagcgtgaatgccattttggcatgttatgagtggcttgaacagaatgttgtaaggaagagaacaaaataacatgttgcagcaaaatgccccgatctgtttatggctcagatcggggtgctttttattttcgccaaaacgttgaacaatccgctttgtcttcgatattaaattcaatgattttctttaggagaggataatcaactggtaagctttccttcatgcgaaacatcttttttccatgatcgtaacccgcttgtacaatgtcagctgaaaagtgatcaattcctttaccttctggtgcgacagatatgtgatgttttgccacgctaaacccaataataaatgtgccatggtctgtgaacatcggctgattccaagcaattcttggctctagtcgagggaatgtgtctaaaatccattgtaaaatgtcttgcgtgcgctgctttagctctgggttaccaatgttgcttacatactcttcaaacacatgcatgatattttatcctcccattccatctacctcataagcctcagacgggattcgaacccgcactcctttcgtaagcataggctaggggcaacacgcttccctacggaatttcaccgacaggaatttcacctgtctcagctcgtgtgcttttcggtgcttctgaaacccttgccttgcgacccgccagctacaatttgttttacggcgctcttcccttctagagctactgaggcgcggaagttattgatcatattatataaagaaactggataaatgaaaagctgcgctgataattagtttactgatctttaggcgaatcgtacaaaatagtcataggcactatgataaaagaccatatggtttgtgtttgtatacagcattgaattgggctgatggaaagtgacaaacctgttgataagtaaactgaaagagatcaatattcacacaaaaaatgaaggttttactcacaaatgtccaataagttctcctttatttgctcatcatggaagatgcggaatctttctactcatgggtgttctttgatagaagtgtccaacaggaataaccgatcctgcacaattgtaaccactaactcaatgtacacctccagtgcttgttgtcttaggcgggacagcggtttctttgcctaataatcagagcttagatggttttacggcaagtggtggaaatacgatttttacagtgccagtatcgggttgctatttcatcgcatattaagtgaacacaaacgcagtgctgcttgctggaacaaggctgattaacagcggatctgccattgctggttttatattaacatccgttttacagcatttccctgcaacgtatcactcattacaacacttgcagcgggtaaccaaatttttggtatagtcgcaacagtggtgttacttggggagggtctgttggagcggcacttatcttcatccgattggaataaagacaaaaagccccaaaaagggctttttttatttcatcactagatgactcgttattttaaaatcgaaaaaaggcggaatttttacgcaaacttcattgactagaagaaagaaacgcattttcaaaggaaacggttattgaagattgaagtgattcatattaaaatgatctcaaatggactaattagcaattgctaatagaagttccatatttagtgaaatcatgtgttgcagctgaaggtgattgggggtgtagaatgagcaagattcctgttgcggaattggcatcattattaaatgactggaacatggaaattaaaaaggatcatgcagatgaggcagaacggctatttgctaaagcgaaacaagcagtagaggaaattgatgatgcggacatccttatgtactattctcttcttgagaagagacatcacattctcatgtacaatttaagaggtcaaaagggcagtgtttcaaccaaaagtatagaaggtcttcacgggaaaaaagaggaggacttatctaatcgacttgcctactattttgatttttatgagggggtgtatgagcagcatcaagggaattacgaggttgcattgcaaatgtatcaaagtgctgaaaagctcttagataaaattccaagtgagatcgaacgtgctgattttgattttaaggtggcctggctttactaccggcttagtcatatcatgctctcattaagctatatccgcagagctcttcacgtttataaacggcacaagcattatgaaagaagaaccgcactttcgtattctctcatagcggcgaatcaaactgagatcggccggtatgaagaggcgcttgaaaattaccgtctggcggaagaggttttgacaaaagagcaggatgattttatgctggctcagcttcatcacaatgtggccattttatattcattttggaataaaccgaaagaatcagtacatcatcttgaaaaagcattgtcccatcaagaatattacgagtcggatttctttttccattctacgtatctgatgagccgggaactctgtgtgattggtgaaaagcagcgtgcaagccaatatatagaggctgcgtatgcgcgaataaaagatgcttctcatgaagtgtttcagctgaaaataggcatcgtccatgacctttacttaacgaatgcaccacaaagatttcagcaaattgatgagaaattaagaaagttagaagagaagaatgaatatcatgaagtaaaagagctttcacattttgcggctaagtattgtgaaaagcaaacactttatgagcagtctgttttttacttcaataaaagtttagaagcggatttacatatgaaaagaatggggttgatttaagatgaaaacaggattaaaagtattattcgttgtgggtttagcggttgctgtggcagttttaactgaaaacgtagcgggttctttcgaagtagcagaaaaaattattggtggttaattcaccatttatctcttgcccttgttgatgatcgtcagcaagggttttttgtatgtgattaataggctcttcttattaaacgctacaagaacgtttaataagaagaattcgcaacaaagggggtgtgcaaatttgttacctgctccattattctaaataatcatagggcagagcaacaagttaaaaaggtcacctttctttgcttaatttaattttttgcaggacttttcattcaaattttatcaaattggtctattgtacatagaatttgttacaaaagagggaacaccgctccatttgtcacgcatatgatgagatgaggtgtaacttgaaggcaggtgattgtatgtatccacgggtatatggaggttttcatggaggcggttttagcggaggagcagtggggccacatattggctttggcgggtattatgtgagccctggcgtgttctctggcttaggaggttatcctggatatggtggattcgggacattttctggatattctccatatggctccacgttcattatggggcgtcctcctggtttttatgtaagaagttattagtgttttatcacagtgattgaaatagccttctagagaatggctatttcaattggtgaaagtgcttaattgcagcagttatcacaatgactccaaggatagagataggcagccaaatgatgataaacggatcgtatgcatctgtgtatgccgctaaagcagcacctaggcagtaaaaaacaatagagcctattcgcatgaaactgacatgctgaatgggagcttttcttttttcctgatgtgaaatgcgctgagccaaatcctcaaataggttagcgagtgtactcgttagaaccgttgtggaaataccagccacatctaatttgcgggcggccgctgtttgcaggcccatggccatacttaaaaggataatcagcataaaataagcaccttgtgtataagggaaaatggtcataagagcaaatagaagcagtatgaggacttctatgataaagatacgtgtaacggcttttggccaaaacgttttctcatgttttccgcctatcacaacagctagtaaaacccctaaaacaaatccactcagtgcagtgatggaatgaagggctgtaagctgcaaggagcttcctgctgcaatgccaagcagcacaatattacctgtcatattggctgtaaacacatgccctaagctcaaatagccaatcacatccacaatacctgctgcaaggcacaagaaaataagtgctatatttcgaaatgaatgtgcggtcaaaatggtcatccctttcttgctctctaatgaataagtgtaacgcttaatgaccgcgtatgtccatcttatgtgccgggataatgtcctcaagccggtgcaaaacttgtctgaaagtgtcatcatttacaaggtgtctcatgcggcggaatggatcgcctttttcctttagacgctctatcacagctggcatggtaaacaaagaagggtgaagtccatcttgatggagttcgtcccattcaagcggtgtcgctacaagcccaagctcatttcctcttggtgaatagggcgcaatgattgtttttccagcatcgtgctgaatatagtctaaatacaagcgattgccgcgttttttcttaagacgttccagagtaaatagctcaggtgcttgttcacataaaaattggcatataaacgcggtaaatgttctcgtttcttcgtatgtgaaggcatttttctttaatggaatataaacttgcagtcctttaccaccgcttgttttaataaaggctgtaagaaagagaccgtctaaaagcgttttgattcgcttagcagcttctatggctagatgaaactcgttaacagatggcgggtctaaatcaaagacgatttcgatcggccgattcgtatcccttgtttcaaaaggaatatgaaattccattgcaagctggttaccgagccaaagaagcgtctgagggtcattacagacagtgtatgaaatatcatcagcttgatcggtcaacacataatgtggggcataatcaggtgtcgatttttgataaaagaattcatcccctgcgccatgaggaaaccgaattaaagtcagccgtctttcacgtaaaaagggcaagagatagggagcggcttgtcttaaataaagtaagtaatctgccttgttcagatgaagagacggcacaatcggtttttcaggatgagtgacgtcaatcacagcagggagcggatacagctgtttgagcatttgctgaaacgtacacgccgctgggtcagtatctagtaaaaaggaagaaaaacgcggctctcttaaggcggacccatcaaaggagatacaagcaatgctcgcgacgatagaaggtgggatttcatatcctgatgttcctatttgtttgccttttgtttgaaaaagcgtacgcagcgtttgttcttcttctttagaaaatccatgcttgaattggacaacctcggtgagatgatgatcttgataaatacagccttggaagtagccattttctttatcaaaacgagtcacaatgacagagatatatcgccagtttttgactttcagccattcttttgaccgtgtattctcgtgccatttactcgtcccttttttcgcaacgagtccttctgctaaatacgtcgtcatcagctttttcatatgttcaggatttgtgtctgtatgaatgagttgaagaagggaagggtgctcaagctgaacagatggcggaagttttgctgctttgaaaacttgctgtacctgttttttcctttccatcaacggcaaatcaattagagattgccctttgcatcttaatagatcaaatacgatcaaatgacatggaaaccgctcagcctgttgcttaatcgcctctttgttttttaatctgcctctttgctgaaccgtcgcaaaatcgctttgctgttcatccagtaaaaagaccaattctccatcaaacgtcagaggtaaaaaaagagcaaactgatcccttaattgttcgcactgttcaatcacctcaggaaactgttcgtttaatcgttttccggctctgctttctaaatgaatcttgttttgctcccacgtcagaatgactcgaaagccgtcatattttaattcatacacccagtctgcaccggtaggaacatcatgtgcagccgttaatcgcataggtttcatttgtgcatgtcacttcctcatatgatgtgttcttagagtgggatgaaattttcattcacatacataagtctaacgaaaacattgcatagtaaagagaaaagaacggaggcgacgcgatgcatacagtttggaaaggcggcattagctttggactagtcaatattccagtgaagctgtttactgctacagagaacaaagatattaagttaagacagctgcataaagagtgtcacacccccattaactataaaaaggtttgtgccaactgcggggaagaggtggcaccagaacaaattgtaaaagcgtacgagtatgcaaaaaataaattcattgagttagacgaggaagagcttgaaaaactgcgaaaagaaaatgaagaaaaagccgttgaaattattgattttgtgaagatagaagagattgatccaatctattatgaaagaagttactttttatcaccagataccggcggagcgaaggcttactcattattaagaaaagctttagaggaatcggggaaaattggtgtggcaaagattatgatccgctcaaaggaacaattagcgatcgttaggtgctatgaacatattttactgatggaaaccattcattttcctgatgaaattagacaggtatcagatgtaccaaatatcccgcaagaggaaaacattgtgaaaaaagagttagatacagcgcttcttttaatcgaacaattaaccacaacttttgatccagctgcctatcaggatgaatacagagaacagctgatgaatttaatcggagataaaatatctggagaacataccgttcagccagaaacgacaggcaaaaaagatcctgcatccaatgtaactgatttaatggcagcgctacaggcttcaattgaccgatcgaaaccagccaaagcgaaaaaagcagcacctaaaaaaagaaaagcaccagcgaaaaaagaaaagaatgcataaaaatagaccgctcctaggcggtcttattgcggttttaacacgtcctgaatgttcccatcatttctatggataacaactgaagtccctttattagaggcaatctccttagcccggttaattgcttcttgtttcgtttgtttgacctcacttgctcgttttgctttctctgtttgaaccgcccagccatcttcatgtttgacgacatgctgggcatgatccataagctctggtcttgcggagctgctgtctttagatggcgtgacagaaccatgggctgagaaattctcgatctctttttccgttgcgttctttttccattctttcgcttgactgatcgcaattgggatggctctactttcgtcatagccttcctgtatcattttgttcgcaacctcaagcgctttttttcgaataatgtgatctaacgaatgaaatgaagccggataatcattcattgtccaaggcatataaaacgctcctttcttttatttgaacaccttcccccatctgcaatggatcaaacatatcattcttctcaaactaatgaaggggataaaatacatcgttttgctgaagtgtcatttcattaaatcccgcagaatagaaagtagaaaaggagtggttttgatgatgataaaaggtttgtatgaagctcatttacctgtgaatgatttgaaggcgtctattgcgttttatgaaaaattggaattgacacttgctcaccaaaatgaaagagttgcttttttatggattgagaaaggaaagagctggcttggtttgtggaaagtagatatcaatgacttcccataccatccctcgactcggcacgttgcctttcaaattacaacgtccagtattgaacagatcaaggcttggctggttgaaaagggcatcggcattcacccaatgtttggcttttcagaagagaggcagcctttagttctggataatccaccgcaatttcatgcagcgatctattttcttgacccagatggaaatctgcttgaatgcattgcgccgcttgagcttgatacagaagaagactacgatagcatgacttatgaggactggcatcgaaagaaaaatccatttatagattgacaaaaaccactcattgtaactatattgattacaacggtggtgaaagattgtgaagcaaattagcagcaggtatccgattgctgttcatattgtgtcatttattgcaggtgttccaaaagagtgtacaggtgattttattgcagagagcgtgaattcaaatccagccattgttcgaaaaatgatggcaatgctcaaacgggcggatcttattgagatccgccgcggagtaggcggtgcttatttaaaaagaccggctgaggaaatcacgctattagatgtgtaccgcgctgtcgatgtaagcgaggatgaagaattatttaactttcatcagcccgtcatcgcatgcccgattggtcaagcgatggatacgagattgcggcatgaactaaaagaagcacaagctgcacttgagaatcatctaaagcaagtgacaattcagcaattattgacagaggcggaataaaaaagctcatacattggagctttttttacacctttgttgtaaccattttgattataacgtatgcacatcaccgttgaacgaaaaatgaggaggtcaaacaaatgaaattattagtaacaggcgcaacaggacagcttggatcgctcgtcgtccagcatttacttaaaaaggtaccagctgaacaaattgcggtgagtgttcgagatccgcaaaaggcagcacatttgaaggaagctggggtggatgtacgcctcggagactttactcagccagacactcttaaggcagcctttcaaggcattgaccgccttttgatcatttcaactgcggatggagaccgcgtgcagcagcatacggctgccatccaagcggcgaaagcagctagtgtatccttgattgcttatacaagcgttgtgaatgcaagagagagtcagcttgtccttgcacacgaccatgcaaaaactgaagaagccattgtcgcttctggtattcctcatgtgtttctaagaaacaactggtatgtagaaaatgaaaaagatacgatactagcagccgttagcggcgcaccatttttaagtccaattggtgatggcaaggttggctgggcaacaagaaatgactacgcagaagcggccgcaaatgcgttaacactttctgaacatagcaaagagaaatatgaactgtcaggacctcttcggacgcatactgaacttgcgcgcattgtcagtgaagtgagcggaaaagagatcaatgtggagcaaattactgtcgacacatttggagaatttttagcttctaatggggtaccaaaagaagctgtgccatttgtcaaagccattcaaagcgggattcgcgatggtgccttagccattgaaagccatgatttcgaaaccttattaggccggccgttaacgcctatcgacgaaaaaattcgtgaaatgatttcaaaataaacatcaaaaacgcccaattaaaagggcgtttttttgtccaaatttagacaaatcacttcgttgaaatttcagaaatttgggattaaaatgaaaatatagcctgttatttcgtcatcagatgaccaaattgatgaatcaaattgcagcaaagaagggaagttcgccgatgaaagtccatttattcgttacttgtttaattgacaccatgcagccaaatgtaggaaaggccacagtggaagtattagaaaggctcggtgtagaagtggaatttccagaggcacaagtgtgctgcgggcagccagcctttaacagcggctattcaaaagaaaccattaaagcagcaaaaaacatgatcaaagcctttgaatcagctgaatatgtcgtgacgccgtcaggctcttgtaaggcgatgtttttagaatatcctcaacttttaaaagaagatccagtgtggtcagcaaaagctgaagcacttgctgagaaaacatatgaattaaccgagtttattgttgatatattacacgtcacagatgtaggcgcgagcctgaaaggaaacgcagcctatcacacttcctgtcatatgacgagactgctgcgaattaaggaagcccctttcactctattgtcaaatgtcaaagatttgacgatgacaccattgccacgcgcagaaaattgctgcggatttggaggaaccttttcagtaaaaatgacacctatatctgagcaaatggtcgatgaaaaagtccaaagcatagaggagacaggcgctgaatatatcattggtgctgactgcggctgcttgctcaatattggcgggagactgaatcgtcttgataaatccattcaagtgatgcatatcgcagaggtattaaatagccgctgactttaagagggggaacggcacatgagtatgaaaattggagcgaaggcctttaaagaacgaatcggggaaggattagaagatacggtcatgagaggagctgtttcctcagcgcaggaacgcctgtatgaaaggcggctatctgcgagcgaagaacttggcaactgggaaaagtggcgagaacttggtgaggaaatccgtcagcatacgctgacgcatcttgatgactacttataccagttaagtgaaagcgttagtgcacgcggaggacatgtcttttttgcaaaaacaaaggaagaggcatcggcgtatattcaacatgtggcacagaaaaaagcggccaaaaagatcgttaaatcaaaatcaatggtcacagaagaaattgaaatgaatcaagcccttgaagagatcggctgtgacgtggtggaaagtgaccttggcgagtatattctgcaagtagatgatcatgaacctccttcacatattgtggcacctgctcttcatatgacgaaagaacaaataagagaagtctttcacgaaaagctcgggtatgagatgtcagagacacctgaagatatgacgagttttgtgagagccatattacgtgaaaagttcctcgaagcagatattggtgtcaccggctgtaattttgctgtcgccaatacaggctccatttgccttgtgacaaatgaagggaatgcggatcttgttacggctatcccgaagacacatatcgccgttatgggcatggaacggattgttccaacgatggaggagctggatgtcctcgttggtcttttgtgcagaagtgcagtcggtcagaaattaacgagttatatttctgtcgtcggaccaaaaggagaagaagaagtggatggaccagaagaatttcacctggttattgtggacaatgggcggtccaatatattaggtactccctttcagcctgttctccaatgtatccggtgcgcagcctgcatcaatgtgtgcccagtttaccggcatgtgggcggacattcatacggatcgatttatccggggccaattggcgctgttttatcgccgcttcttggcggctatgatgactaccaagagctcccctttgcatccagcctttgcgcggcctgcacagatgcttgtccagtaaagatcccgcttcacgaattattaataaaacatcgacaagtcattgttgaaaaagaggggagagcgcctaaagctgaaatgatggcgatgaaaatgttcggaatgggtgcatcgactcccggtatgtatcattttggaacaaaagcagctcctgtattgatgaatcgtatggcttcaaacggacagatttcaaaaggaataggtcctttaaagaattggacagatattcgtgacctgccagctccaagtaaagaaagattcagggattggtttaaaaagagacagaaggaggagcagtgatgaagggaaccatttttcaccgagaatcgttcttagcgcatattcgtcagcaattagggaaggattcctcctcgtctgcatctattcagcgtccggcttggaagcatcaagttcagtgggaaacaaacggacttttgtctaaagaagagctagttgagcaactgaaggtgcaatgtcaacgaattcacacaagagtggtcgaaacaaaacctgaggaagcgccctctgtattacgatcattgatgacagagtatggagagggttctgtgatgacatcgggcgatcatcgttttgaacaatatggattttatccgatgtttgacagcttgcagcacgaagggttcgcagtcaccagctggaatgctgaagcatcaagggaagaaaatatcaggctggcagaacaagcggcttattcggttgtatttagtgattatactcttgcagaatcagggacagtcgtcctttcatcccatcagggccaaggaagagcgctgcattttttaccgatgatgtatatcgtgtgtgtcgaaaaaagcacggtggttccgcggatgattcaggcagtttcggctcttaatcgctcggtagaggagggggaagaggcgaaaggtgcgattcatttcatatcaggtccgagtaactctgcggatattgagatgaatttagtagtaggtgttcatggtccagttcgggcggtttatctattgatagatgatgaatagggctttcgagatgaaagccttttttcatacaaaaaaagcttacatcagttttaaaatcatcttgcctctagcggattggacatagtaagatgacgacatacaaggatgaacttctcatctactgctgatgtaaaggaagctgctcatggacatgaagtcaactgctcaaaagaaatcaattgcactaccgcttgtgatttcaattattgccatttcgttttctgctattattgtgaaatggtcaaatgcacctgctgctattttaagtatgtatcgaatgatctttgccgcggtttttatgctgccgtttattctgccacgaaaaaaagaatttctctcgattcagagaagagactggtttttcttatgtatgtcaggcttctttttaggactccattttgtgttgtggtttggctcactgaagctgacgactgtggcaagctctactattatcatcgcccttcagccgatggtctccttattaggcggctttctcatttttcgtgaacgaaccacgctccctgcacttttgacgatgtgtgccgcaattgttggtgcacttatgattgggtggggagacataggtcatagccaggaagccatcctaggagacattttatcctttttaagtgtgatcgccgttgtttgttatttattaataggtcaacaggctgtcagaaagatatctcattggatttatagtttttgtgtgtttggttttgccggtctttttttaattttatttaatttgatgcagcaaactccttttacaggctatccaggtaaagagtggggaatctttttattgcttgcgatcattcccaccatgtctcatgtcattaataattggcttttaacctatgtcaatgccacaaccatttcaatgagtatccttggcgaacctgttggagccacgattcttgctgtatggctgcttggagaaaaagtcacgctgcttcaaatgtgtggcggttttcttgtccttttaggcgtctttttctttttgatgcagcagcggcaagggattgtgatgaaacaaaaaaaatccggttaaatcccggatttttactcttttaaatcgttcttttcaatcactttgtttaatctttcctcgaccttcttcaattccattcgttttcttctgatcattcgaaaagcgatgacaatgatcgtcacgatagcagcaatgaatagaagagagaacacttgaaatagaagatcacccatgttaaatgccatattctctccgttagacatacgtaaaacctccctttctatctatatattaccataattaataaaagattgagatttatccattatttatctataataggtaaaatatcacttgttaaaggagaaccaatatgagaactttagtccttttacgaggtctcccaggcgcagggaaatcaacttggatcaaagcccaaggcttagagccttacacgttatcagcggatcagatccgtcttttgacccggcctccgcagttatctgtcaatgggaaaccagaaatttcaagcaaacatgaccacaaagtctggtctttattatttgaattgcttacagctcgtatggaacgtggagattttactgtaattgatgccacgcatatttcaagcaaatcgatatctcaatataaatcgctggccacatcgtatcgttacagggtgtatgtcgtcgatttcacgcaggtgccgcttgaaacagctctcctgcaaaatcgctcacgggaagctcacaaagttgttcgggagtctgttttatatcaaatgaacgagcgtttaaaaatagaaaaggtcccatcatgggtgacggtcttgcagccggaggaatattcgcaagtgatgacctatcagcctcgatcctttgatcaatatgaggccattcatatctttggagatattcacggctgtcatactgctctgaccacctatttgcaaggagatattaaagaaaatgaactttatatatttgcaggtgatttacttgatagagggatagaaaacaaggaagtattagaatggatgctcgcacatagagaatgccggaatgtcatcgtaattgagggcaatcatgatcagcatttataccggtttgcacatgatgaaaaagtaagaagcaatatgtttaaccggcatactgcacctgaaatcgaagcagcagactttgatttaaaagaagtacggaagtttgtcagaacatttcatcagctcacttattttacgtaccatggcaagacatttcttgttacccacggggggcttgctcatttgccagaagagcttctgcatgtctcaacacagcagctcattcacggtgtaggtgaatattcagatgacattgaccatttgtttgttcaaaacactgctggattagatgtcattcaaattcacgggcatcgcaatttatacaggctgcctactcaagcagcggaaaggtcttataatctagaaggccaggttgaattcgggggacagctgagggtgttgaaaatcacagctgacgggattgagacacatgaaattgacaacccagtctatagagcttctgaaaaaaaaccatcggctgctattcaaccagatatctcactagatgactttttagctcacttagatcagcatgaatatgtacaggaattaaagcttccgcaccatatttcatcttttaattttacgaaaaaagcgtttagtgaacggcagtgggatgatgtgaatgtgaaggcaagaggtttgtttgtcaatatggtgtcaaagcagattgtttcaagaagctacaacaaattttttaacattgatgagcgtccggagacaaaaatgcatcatctagtgaaccaccttcaatttcctgttaccgtctatgataaagcaaatggatatttagggacggttgggtataacgaaatggaagatgaattggtgtttacgtccaaatcgtatacatctcatgtgaagcaaaaccagcatgcttcttgggtcgaagagttattctatcagaccttcggagacgtgcaggtcgactacatcaaatcatacgtacgtgaccacaatgtatctcttgtgtttgaagtcattttgccagagaaagacccgcatataatcacatatgatcatgatcaactcattttacttgatattgtgaagcgtcagctgagctatgaaaaggcaccttttactgaagtgaaaagagtaagcgaacagcttggaatgtcctgtaagcaggaagtggctgtgttccatgattggacctctttttataaatggtatcaggccgtctctcatgacgacacgatcaaagaagagggatatgtcattgaggatgatcgcggctttatgaccaagctcaagcttccttattatcaattttggaagcagatgcgttcgatcaaacagcgcgttgcagagaagcgttccacgcaaaaatatatgcaggcattgcaaacagcggagcaagctagattttatacgtggcttcttgagcaagatgccaatgctgtcagaaatagctccattattgagctgcgttcacaatttgagcaaagcgatgctgtccaattgaataatgatggaataaatgcatagtctaaaaagaagtcttttctaaggaaaaggcttttttgatgcaattgaaaggtggacccttacatgccagaccatattgaagtcattttacggacgatgtttgcttttgcgattttatttgtcggagcacgtcttcttggaaaacaaaccattgcgcaaatgaatatttttgattttatagcagccatcagcttaggttcaattgcggcgagtctcgcgtttaatactacgctgccgtttcatcacacgacgatttcctttgtcacgcttgtcatgatcatttatgtgatttctctcattgctttaaggagccgaaaattgagaggatttatggccggtaaaccaacccttgtcatacaaaatggcaaaattcttgaagagaatatgaagggaatgaggtatacccttgattatttaaatcagcagctgagagaaaaagacatttttgatattagcgaagttgaatttgccatgattgaaacagatgggcatatgtcagtgaaaaaatatccttcgtttgaaaatgtcactcgaaaggatattcaattgtatatgaaggcagagggctacatgcctatcgaagtgatcatggacggaaagctcattttgaaaaacattcatgaaaatcaattaactgtggagtggatagaggaagagcttaagaaaaggcagctctccttaaaggacattgtatacgcagtccgttcaagtaatggcagcttatatattgatacatatgacgaccacattcactctccgattgatcaagaatgaaggtatagtgcggaggtcaccctcctgacacatatctgtcagtgtttctaagtcgtttggatgctgtctgactaggcatcatttctcaattattattattttcagaaaatgtggtgacggagaaaaataagtatgtttaagtataaatagaagaaattaaaatattaatataatatatatcaagcggaatgaacattcattcctagtgaaacgaaaggagaggatgaaatgtctgtagcgactagtgataaacaggagcagattatgaaggcttcactggacttatttattgaacgtggctttgatggcacaacgatgccgatgatttcaaaaaaagccaacgttggagcgggaaccatttatcggtatttcgatagtaaagaagcactcgtcaacattttataccagcgaagcctcactgcgtttatcgacaaaatcagcacaaacagtccagacccaaaagcaagtatcagagcctattttaagcatgtcttttattgcttggttttgtttacaaaggagaacccgagtggtctgtacttcttagaaattgataaacggtcacattatttagatgagataagtaaagagaaaatgcagcaattgttaaatgagctatttctcatctttgaagaagggaagaaggatgggattcatccgaatctatcagggagaaccattttatccattgtatttggcgcattcgtccagcttcacaagcaaattcttgcagaagaaatagagccaacgattgaatttttagaggaaattgagcaatgtttatggcgcgccattagcgttgcatcataaagaaataaagggagtgggcatatgaagcaaacatcaatcattccaaaaccaaaaacatacggaccttttaaaaatattccccatataaaaaagggagagctttctcaaaccttttggcggctagcagatgaattaggaccaatttttcagtttgaattttcaaatgcaacaagtatttttgtttccagccatgaacttgtcaaagaagtatgtgacgaaagccgttttgataaatttattggaactagtctcaataaagtaagagcatttgcaggagatggactatttacaagctggacagaagaaccgaactggagaaaggctcatcaaattttgatgcctgcatttagccagcaggccatgaagggctatcatgagatgatgctcgatattgccacacagcttgtgcaaaaatggcaaagaacaggccgcgatgaagaaattgaagtagctgaggatatgacaaagctgactttagatacgatcggtctttgcggttttgattttcgctttaacagcttttataaagaaaatcagcatccgttcatcgaaagcatgctgaaaggcttaaatgaagcaatggagcagtcgagccgattgccgattgcagataaactcatgatcaaaagaagaaaagaatttgaccagcatgtcgattttatgtcgaaattagtagatgacattattcaggaacgaaaaaaacaagataaaacgggcgatgatttactgtcacttatgctgcatgcagaggaccctgaaacaggtgaacgtttatccgatgaaaatatccgttatcaaatcattaccttcttaattgcagggcatgaaacaacaagcggactgctatcatttgcgatttatttcttactaaagaatccagagaaattaaagaaagccgtccaggaagcagatgaggtggtgcaaggcgggcttccgacatttaaacaggtgcaaaagctaagctacactcgtatggtgttaaatgaagcccttcgcctctggccaacagcgcctacgttctctctttatgcgaaagaggacacagtaatcggggagaaatatccgattcaaaagaatcaaagtgtctctgttctgctccctaaattacaccgtgatccagcagtatggggagaggattcagaagactttaaaccagagcggtttatgcaccctgagaaaatcccgcagcatgcctacaagccttttgggaatggacagcgtgcatgtatcggtatgcagttcgccctgcatgaagctacgatggttctcgcgatggtcctgcacaatttagagttaattgatcacacatcttatgagcttgatttaaaagagtctctcacaattaaacctaacgattttaaaatcaaagtgcggccaaggaagcagcaattctttatggctccaccgaaagaagaaccgaagaaaagaaccaaatctagtgagtcaaaagtggcgagtcacggtactccgctgctagttttgtacggatcaaatctcggcacagcaaagcaaatagcgaacgaattggttgaagacgggaaagcaaaagggttcgatgtgaccactgcgccgcttgatgactttacacgccgattgccagatacaggtgctgtcctcatcgtgaccgcttcatacaacggacatccacctgacaatgcgaagcaattcgtggattggttgacgcaggatgaagagcaggatctatcaaacgtgacatttgcagtctttgggtgtggagatcgaaattgggcgagtacgtatcagcgtattcctcgtctaattgatgaagcatttgagaaaaaaggggcaaaacgtttaacggatattggtgaaggcgatgcaggcggtgatatggatgaagataaagaaacattccataagacggtcttcgacgagcttgcaaaagaattcaatttaaccttgcaggagaaaagtcaggaaaagccgagcctatccattgcttatacgaatgagctagtggaacgtcctgtggctaaaacgtatggtgccttttcagctgttgtattgaaaaatcgagaactgcaaaccgaaaaaagtgcccgccaaacaaggcatatcgaacttcaattacctgaaggcaaacaatataaagaaggagaccatatcgggatcgtgccgaaaaatagcgcagcactcgttcagcgggtgaccgaccgttttaagctagatcctgagaagcacatcaggctctcttcggaaaaggaaacaagtcatttgccattaaatcagccgattcaagttgaagaattgctggcgtcacatgtagaacttcaagagcctgcgacacgtactcagttaagagagcttgcaaaatatacagtatgcccgcctcatcgtattgagcttgagcaaatggcgggagaaggttatcaagaagctgtattaaagaagcgtgtgaccatgctggatttactagaacaatatgaagcatgtgaactgccttttgatcatttcttagcccttttaccaggcttgaagcctcgttattattcgatctccagctcgccaaaggtagatgaaaagcggcttagtatcacagtagctgttgtaaaaggcaaagcatggaacggacgcggagaatatgccggagtcgcatcaacctatttatgtggtctgaaagaaggtgaagaagtcgcctgcttcctccacgaagcgcaggcaggattccagctaccaccttcatctgaattaccgatgatcatgatcggaccaggtacaggaatcgctccatttagagggtttgttcaggcaagagaagtgtggcagaaggaaggcaaaccactaggcgaagctcacctgtattttggctgccgtcaccctcatgaagatgatctgtattttgaggaaatgcagcttgcagcgcaaaaaggtgttgttcacatccatcgtgcttattctcgttacgatgagcaaaaaatatatgtccagcatttgttgaaagaagacgacggcacgctgatcaagttacttgatcaaggtgcgtatctttacgtgtgcggggacggaaaagtcatggcaccagacgtagaggctacattgatcgacctctatcaacacgggaaacaatgttcgaaggaagtagctgaaaattggctgacaacccttgcaaataataatagatatgtaaaagatgtatggagctgacaaaaggaaaaaccgccaattaggcggttttttctgtttcatcaagagaggtgagatcggtagaatgaaagtttgaaagttacaaaacacctaatttagaaatgaaatattttgtaaaaaataagaatattctctcatttactccaatatgaaacaatcgtatcatttttgatataggacataaaggaggaatatgatgaaaaaggtgaaaatgttactcccttctctacttgtttttggtgctttaagtgtgcctagttttgcccatgccgcatctgattcagtgctaacgtctgattatgacatggtgacttctgatggaaaagtgatctcttcaagtgatttccacaatgatacgaaatccccctcatcctttgataaagtggatgatctatcttcaactgttggtgaaaaagtaaaaccactatcaaaatatttaaaagactttcaaacaaaagtcgtcattggagacgatggtagaacaaaagtagcaaatacaagagtggcaccatataattcaattgcttatattacgtttggcggctccagctgcacggggaccctgattgcccctaacaaaattttgacaaacggacactgcgtgtacaatacagcatccagaagttatagtgcaaaaggatcggtgtatccaggcatgaacgatagtactgcggtgaatggctcagcaaatatgacagagttctatgtaccaagcgggtatatcaatacaggtgcgagccaatatgattttgccgtgatcaaaacagatacggacattggcaatacagtcggttaccgttccatccgtcaggtgacaaacttaactgggacaacgattataatttctggatatccaggtgataaaatgagatcaactggcaagatctcgcagtgggagatgtcaggtcctgtgacaagagaagatacgaatctcgcatactatatgattgatacatttagcggaaattcaggctcagcgatgctagatcaaaatcagcaaattgttggggttcataacgcagggtattcaaacggtacgattaatggcggtccaaaagcgacagctgcctttgttgaatttatcaactatgcaaaagcgcaataaaagctaaatcataaagcttgtttccttcataggggacaagcttttttatgtggatacaagtgtctatctgtttatgcttgaaaaatccattgacacttagcctcttcatttttttcacatgtcaatcgtgaacgactcatacattaaaatgacacattccctttaagtcaagattctgcttgagaaaaatgaggaggtctcacgcttttgaagatgagaagaggctggattactgctgtcgccttatgttttgtgatatggatgggcacgctgttaggtggatttggagaggaacatgcggcaaaaggtgcggatcgatatgatcatgttattcaatttccaaaggaacggtaccctgaaacaggcagtcatattcaagaagctattcgaaaagggcattcagatgtgtgtacgatagaccgaaatggagcagatgcccgcaggcaagaatcattaaaaggcattccgactaagcctggattcgaccgagatgagtggccgatggcagtttgtcttgaaggaggaaaaggggcgagtgttcaatatgtcagcccgtctgataataggggagcaggctcatgggtcggacaccagataagtgggtatcctgatgggaaaagaattttatttattgtgaaataaaactaaaagagaggcgcctgtgagtaggtgtctttttttgttcgatcagagcgtattggagttagcagggacaaaagattcagtgtacaattgatctataagatacaaagatagacaagaagaaaatgggaagggacatatgcttatggataagaaccgtgcattatacgattatttcatacaacatgcagagaaactgactgaaacttggtacgattcaattgaggatgatgatccagaatcaatttatcgttcaacagattccagcatcatatcagagctgaaacggcaaaatcaagattattaccagcattttatacgtgctcttattgaagacaagacatatttacatactgagtttaaaaagtggtctgaagatttagccagtgacccgaagcatttaaacacaccattagattatgttgtgagagaatacatgtccaatcaaagagtggtccttcattacttaaaagaatttattaagcagcgtcaagatgaaattgatattgaccgcatcttttattggtatgatttaatttcagaggcgtttaatatttccattcatgtgttcatccagcaatatgtaaaaaatacaacgaggaagctcgtggcacaaagagacatgatttacgagctgagctcacctgtcattgtcttaaaaagtcatattgcgttattgccgttagtaggtgatattgatacagcgagagcgaagattattttagaaaatacgctgaaacagtgctcacaaaaaggagtacagcatttatgtattgatttatcgggcgttgtcattattgatacaatggtggctcagcagatctttgatcttgtcacatcacttcggttaattggagtagagacaaccatttcaggaatcagaccagaaattgcccaaacggctgtacagctcgggcttccttttaatgaatttcgcaccgcagcatcacttgctcacgccctagaccgcatgactgaatttacttcaatataaaaaccaggccattcaatcggcctggttttttatttagataacagcgtcaatttttgtgactttccaatctttttgtcctttttcgaacgtaaccgttctttttactttgcgtccatcaagtgttgggacagtgaattcatatgtgcggactgtttgttttttagagacaagtttaggtgtggctttatcccaattaagcatattgtcaccgtcgccgactggaacagccattttgcctttatgaacaatgaactgatagtcttttaaaccttgattaatggcttcttttgtgaaaacttgagataggtagctgtttagttttttctttgtatcaaatgttttagaaagatagttgtaagtcatgtctttatagctaaatgattttaatttgtaatcagaatgttcattaattttgtagcctgacatcgcactccaaaagtgttcccgtgcatcaagggcaatatgtaacgcttctttatttgtcaaagtggctggttttttagaagcggccaatgttgtagattgtaatgagatcataagcataatagcagttaataaaacgaataattttttcaaggcgattgcctccttttctcaatgaaaacttcttatgttacaaatgttacaataattacagtgatattacaagtattaaattgaaatgttttttatttcttttctttctatatatataacgtttgagggtggcaaaaagttttcatttttttattttttctttatatctactatttaaccgttctaaagaagaacaaaacgttttttggaaaaatttctgtttggatgttcaacacgctttgtcattgatgacatatactatcgtgatgaatgtctaggaaagtggtgttgaatatgtattatccgtatgaaggtgtgtggaatgggtactcatatgacaggcagatgcaaggttggccgtcgttcccttctcaagttggaggatttccagggtttccaatcggaggaggaggcactgggcccggatctagtggatcagccccgccagctccaccacagcatatcatttcgcaatatcagcaagcgttatcgcagcctcaaagcatgcagtcacttatttcagggcagacaggtggaggacagcaatcggttcagtttgctgcgggatgtaatagaagatggacgattgtgtttatgagaaacggtcaagtgtttttaatgtatgttctatcttcacagcctttcgggagaacaactggctttatatggccgaactttacatttggttccttcccaagctcgagtattcttgcctattcttgttcataaaaaaaaagccggttctcatcattagctgatgaaataccggctttttttagtggatatttctaaatacgccaatcactttacctagtatacttacattctgtaaaataatcggttccatagatgggttttctggctgtaatctaaagtgtgtatcttctttatagaaacgcttcactgtcgcttcatcttcctctgtcatggcgacgacaatatctccattgttagcagtgctttgctgacgcacaatgacatagtccttgtccaaaattcctgcgtcaatcatactttctcccataatttcaagcataaatacttgttcatctggtgctgcaaaagtctctggaagagggaagtattcttctacattctcaacagccgtaataggcaggcctgctgttacttttccgatgactggtacgttcagtacagcactctttgggatattcatttcctcttcatctaatacttcgatcgctctaggttttgtcgggtctcttctaattaagcccttcgtttctagtctagctaaatgtccatgaaccgttgaacttgatgctagaccgacagcttctccaatttcacgaacagatgggggatagcccttactttttacttcttctttgatgaatgtcaggatatcgagttgtctttttgatagcttcgtcatcttttgcacctcaaaacgtcaattttaaagaaattatagcatgtttttcctaacagtacaaacataggttcgaaaaaaacgtttgacagaaacgtttgttcgtatttataataagtgacagaaagaacgaacacacattctattaggagagatgacattatgaggttaaaagaatctattatttttattggggtattctcattcatcgttggcatatttctctcacttattgcagtcacaagccataatgatccaaatcaatatgttaaaatagaagttcaatcaggtgatactctttgggggttagctgatcaagtaaacgacagcaaatcaatcgataaaaatgcgtttattgactgggttacccagcacaatgatcttgcttcaacagaaatccagcctggtgacatccttgttataccagtcaaaaaagagcatccagtcgtatatcaacttgcaacagtacagtagaaaggtcgattgaagacatgaatgcaatcatttatgcgagagtaagcactgttaaagaagagcaggaaacctcgctgaagagacaagaagaagaattgctggctttagctgctatgcacaagatgaatgtggttaaagtcattaaagaaaaagcaagcgggtatgatctagatcgtgatggtgtgtttgatatgctagctacactaaaagaagagtcaattgatgctgttcttatccaggatgaaacacgtctcggaagaggacaagcaaaaattgcgcttctccattgtctttttaaagagaatgtgaaggtgtacagtacgtttcatagaggcgagcttgagctttcagaagcagatgaaatggtgattgagatcgtaggagtcgttgaagaatatcaacgaaaaattcataacctgaaaatcaagcggggaatgagaagagctgtagaacgcgggtaccagcccgaactgaatttaaaacagcaggatcatgcgcctggtcgtgagcgtattgaagtgccaatttcagaaattgttcgattaagaaaaaacaacatgaccttcgccgaaattgcagcaactcttcaggcactaggttttgacatttcaaaagcaacggtccatagaaggtatcaagaatatgaaaaaggtctgaccacctaaagctcgatttgttgtcaaaatgattgatatttagtagtatgtagagaaaatgttttaaaggagttagtcatgatttctaaaaatcagcttgcaagaatcaatgagctttcaaaaaagtcaaaagagaccggtttgtcagacgctgaaaaaacagaacaaaagcaattaagagaagagtatttaaaagcttttcgttcttctatgaaaaatacacttaaaaccgtgaaaatcgttgatcctgaaggaaacgatgtcacaccagaaaaattaaaaagagaaagagatcaaaaccttcattaatagttgtatgatttcttgaattttgaaaagatgggaagaatattctcatcttttttcatatttgcataactttttaggtgatcgataaactaaatgtgacaaaatccttctttttcagcgtgaaatagttgtgaaaaaaggacagtagatttatgataatggtgtacacaagatacggaaggggatttatatggaaacgattgaattgaaatctattgcaacaatacgtactctctccatagacgcaattgaaaaagcgaattccggtcaccctggaatgccgatgggtgctgcaccaatggcatacgctttatggacgaatcacttaaacgtaagtccgcaaaacccaagttggtttaacagagaccgttttgtattatctgcgggacatggttctatgcttctatatagcatgcttcatttaagcggatacaacctgagcatcgatgatctaaaacaattccgccaatggggtagcaaaacacctggacatcctgaatttggacatacagagggcgtagatgccacaacaggtcctttagggcaggggattgccatggcagttggtatggcacttgcagaaagacaccttgcggaaacgtataacaaagacaactttaatgttgtagatcactatacatacagcatttgcggagatggagacttaatggagggaatttcctctgaagctgcttcacttgctggtcatttaggcttaggccgtttaattgttctttatgattcaaatgatatttctttagatggcgacctagatcgttcattctctgaaaatgtgaagaatcgttttgaagcgatgaactgggaagttctttatgtgaaagacggcaacaacattgaagaagtgacggctgctattgaaaaggcaaaacaaagcacagacagaccgacactgattgaagtgaaaacaacaattggttttggatcgccaaaccgtgcaggaacatctggtgtgcatggtgcaccacttggcagcgatgaagccaagctgacgaaggaagcttactcttggacgtttgaagaagatttccatgtaccttctgaagtgtacgatcatttcaaagaagctgtaaaagacgcaggtcagaagaaagaagcagcttggaatgaactatttgcgcaatatgaaaaagaataccctgagcttgcagctcaattgaagcttgcgattgaaggaaagcttcctgagaattgggatcaagaggttcctgtttatgaagcaggttcaagtcttgcctcccgcgcttcttcaggcgaagtattaaatggcattgcaaagcaagtacctttcttcattggcgggtctgctgaccttgcaggttcaaacaaaacaacgattaaaaacactgacgattttggtaaagagaattatgccggcaagaacatttggttcggcgtcagagaatttgcaatgggtgcagcgttaaacggtatggcgcttcacggcggtcttcgtgtattcggcggaacgttctttgttttctcagattacttaagaccagcgattcgtcttgctgccttaatgggacttccagtcacttatgtctttactcatgacagtatcgctgttggtgaagatggtccgacgcatgagccggttgaacagcttgcttcattacgtgcgatgccgaacctttctgttattcgccctgcggatggaaacgagacagctgcagcgtggaaactggctgtatcttcaacggataaaccgacagcactagttctgactcgtcaaaaccttccaacgattgatcaagcacctgagaaggcatatgagggagtagaaaagggtggatacgtcgttgttgaagctgctgatgcacagcctgaagcacttctacttgcttccggatctgaagtcggcttagcgattgaagcgcaaaaagcacttgaaaaagaagggattcgcgcgtctgttgtcagtcttcctgcatgggatcgtttcgatcagcagtcagacgaatacaaagaatcagtccttcctacagcagtacgggctcgtattgcgattgaaatgggggcttcacttggctgggagcgttacactggtcttgatggtgacgtaattgccattgataaatttggcgcttctgcacctggtgaaaccattattgagaaatacggttttacggtcagcaatgtcgtcagccgtgtgaaagcgaagctgaacaaataaccagtctccaagcatcatgctttttttcatctgtttgcagagcattttcatccgctctgcaaacttttttcttttttcttgtttttttgacaaaactagtttcttcttgcttcatatatagacaattctttctttcacatttttgtataatacaagcaatatacgagattgacgaaatgtgaaaggaagggatagacatggaacgccattattatatttattggattgaggatgaatttgcccatcattattttggcagagaatcaattttgtttcatttgtttgagtcgttacactggacgaaccgcacggaagatgaattggtgatgcttgtgaaacaagtggattacgtgacgaaacgaatccctgcttttcatatgcaccagcgattaatgaacaacttaacgaatattcactatacacaaattggctcgatatacagcgcttccttacctgatggaaaaggaacggctgcatttatcataaaagatcgttatatccaaatgtctgccaccggcagttatgaagcagaagcagtgttttttgaagtgctgagaaaaattagtccttgcttccttgcgatggacttcggttcaaagaagcacgggtggctcaatccggtaaaagtgaggaattttgtttaaaaaaataaaattgaacgtgaaatgttgtataatagccttttgtttagtacactttatacgagacaacatgaaggaggaagaattatggatttatgggttgtcatccttgtaggcgttgttgcactgcttgcaggagttgcactcggattctttattgctcgtaagtatatgatgagctacttgaaaaagaatccaccaattaatgaacaaatgcttcgaatgatgatgatgcaaatgggcatgaaaccgtcccagaagaaaatcaatcaaatgatgaaagccatgaacaaccaagcgaaataatacgtacgatattatgatcatagatggaacatggttataaagaatggacaagcgtttgtcctttctttattgaattcaccttcatcagacgctttaaaaccactgtacttgcctaaatgaagcagggaaggtggtttttattttggcttcagcttcctgctaaaaaacaaaaacccctgttatcagaggtttttgtttcgtttatggtcacacatatcaactgttctaaaaatcgtgtagcatgataatatcatgagatatgattagttggctgagtttgagtgtaagtgtcgttgatattgtaagaggagatgatctagctgctggctatgttcgatggtcactgtggatgtcatgccattgtgcaagacaactttcatcagctcttctcttttttcttcgatttgagttaataatgatgtttttaccaaagtcatgttcctttcatgcaaatcttgataaaaagaatcgattctattatatccattttaaggtttattttcaaatttaaaggattcgttatcttgatgtcaaattaaattatataaggttttaagagaatagaccatctttattgagaggatgtaaaaaaaatgaaatgattttgtcatctcttattgtatattgtaagaagggggtgctcttttgacagatttgaatttctttttagcttttggagcagggtttctttcttttatctcaccatgctgtctgccgctttatccagcctttttatcgtatattacgggcgttagtatggatgaagtgaaatctgagaaggtgatgctgagaagaagaagtctacttcataccttattctttttagttgggttctctattatctttattgcgattggctttgggacatcgtttgttgggaagttttttgatgattaccatcaagcgattcgccaggttggagccattctcattattttctttggctttatgacgcttggtgtatttcagccttctttcctcatgggcgaaaagagaatgcagttcaaaaaccgaccagctggtttttttgggtcaattctcatcggaatgggctttgccgctggatggacaccttgtacaggacctattttatctgccgttatcgcgcttgctagtaacaatccagagtcggctgtgccttatatgattacatatgtccttgggtttgccgtcccattttttattctatctttcttcattacgaaaatggcatggatcagaaagcgtcagcagcttattatgaaaattggcgggatcattatgattgtggtagggatattgctgttctttgatcttctcacatggattatcatcatgttctcatccttgtttggcggatttacaggcttttgaaatcgttttctacagtcgcggcgaatggttttttttcgtcaattggagtatattatacataggctgaccttaaagaataaaggaatgattagatatgatggtcataatctcttctataattgcggtatgtatggcggtagccgtcatgtttattcgcattaagtcatctgcaaaaccggcaactgcaaaaaaaattatattgcctcctattttcatgagcacgggtgcattgatgttttttgttcctatgtttcaggtaactggggctgaatttctcgaggcaatcacagtggggatgtttttctccatctttttaatcaaaacatcgaagtttgaaattagagggaatgagatttacttaaagcggtcaaaagcatttgtgtttattctcattggacttcttgttcttcgtattggaatgaagacaatcctgagttcttctattgattatggttctctaagcggaatgttttggatacttgcctttggcatgattgtgccttggcgagttgccatgtatttgtcgtttagaaagatgtctaagcaattagatccgcagcaggttcaaatgaattaaattcagattgttgaaaaagggctaaatctttattttagccctttttcttctttgaacctcctttttaaaaggaggttattttaataatgcttcatatggcgtatgatcgatgtttttttcttgaaggcgcttcaataaaaacttatgatcacgctttggtgtagcgataatatagccgcgaatgattaagtctaaattaatgctggcagcttgttcttttaaagccagctcgccaatttttcctgcaattttttctttggcgacatctctaaacagctctggaacaggtaatacaagttcatttaaaagctgtttgtcttcttcccgccataggtggaggctcttttgaatatattcatcctgccaatcaagctctgatttcccatcttcctttggcaatcgttttaaaaatttgcgaaacataaaaaagccaccgattgcgagtaatccgatcatcaccgtaccccaaaataaaatgaaccacaaaaaccagccgcttaacatgttctcactccttataccccttgtctctctatcttattttacatgaagaaatgatagaagaaaataacaaaaatgtatgtctcttatctctatgaacgccttttttcattcataactgcccatttactagaaagacccaaaccatctagtagaaaaagaatacattatcatatagcgactctactatttggccatggtggttcgcaaaaggtattgacttgacacgaacggaagagagcccacctatatgaaggtgggctcttaatgtttgaagtgcgggacttgaaaggaaaatgcaccgtttggatggtcagaacttttattaatccttatcgaaatgattcggttttcgtattctgtttcaatctctttgtcgttcaaataaaaagggagcatgacacttttttcaattggctgttcgcctttatcatttggctgttgtactgtgtaagcgagagtgagctcatgtccagcgaaggttagttttacatcagtgatcgatagggtggagacatcgatttcgataatataatcacggcttgtttcataaagatcaattgggaggtgttcatcataccaggcaaatggatcatccattaaaacattgagccaatcgtctatttcaagaaaatcagaggaattcgattgcttttcattctccataaacactcctccatcacatctcataataaatcatatgatgaaaatggaaatgtgtgaaagacctaaaacatcccgttttgctacgggatgagaggagaatgtttacatatcgtgatgagaattgtgtttttgtcttgtatggttgcggttttttacttttttactgcctgataatggctcaggctgtccgctctgatgttccttaggcgagttttgacggatgtcttttcctgtgtttttattcgtcatgatgcttgctcctttcttattggttttttttgcgttttttattgttttgtctttgttcttctgttaaaacgagttgatcatcttcaatatagcctgcaccatttccttggcttttggctgcgttcatgccattaatgacatgatttgctttgcgttttgtcatgttctatcacctcatttgtagtatgagcccgccccgcttcgtttatgaagagtaatcatttcctaatgataagttaaacttattgaatttaataaaagcattgttatttacttatgtatgaatttgttttaagatgaaattgtgagaaaattgtggtgaaatacgacgatttttctgagaattgaaattgatcttgatcatcaaaagggggattttggacatgtcgaaacagcagcaagtcgctaaacaagacgcttttcaatctagaaaaacgttttcgacaaatgggaaaacgtatcactattattcgttagaagcactagagaaacaaggaattggaaatgtttctaagctgccttattccattaaggtacttttagaatcagtgcttcgccaagtagacggtagagtgatcaagaaggaacacgttgaaaacttggcaaaatggggaactgccgaggtaaaagaaattgatgttccatttaaaccttctcgtgttattttacaagacttcacgggtgtaccagccgtcgttgaccttgcttctttaagaaaagcaatggcagatgtaggtggggatccggataaaatcaaccctgaaattccagttgaccttgtcattgaccactcagtacaagttgataaagctggaactgaagatgcattaaacattaacatggatttagaattcgaacgtaacgcagagcgttataacttccttagctgggcaaagaaagcgtttaataattatcaagctgttccgcctgcaacagggattgttcaccaagtaaacttagagtaccttgcaagtgttgttcatgcgattgaagaagatggcgagatcatcacttacccagatacattggttggtactgactctcatacaaccatgatcaacgggatcggcgtacttggatggggcgttggcggtattgaagcggaagctggaatgctcggtcagccttcatacttcccagtaccagaagtcattggtgctaaattagttggagagcttccaaacggaacgactgcaactgacctcgcactaaaagtgacacaagttctgcgtgaaaaaggcgtagtgaacaaattcgttgaattcttcggacctggagttgcacagctgccgttagcggatcgtgcaacgattgcaaacatggcacctgaatacggtgctacttgcggattcttcccagtagatgaggaagctcttgcttaccttcgccttactggacgtgatgaagagcaaattaatatcgttgaagaatattctcgcgcaaatggcttattctatacgccagatgcagaagagccaatttttacggatgttgtggaaattgatctttctcaaattgaatcaaacttatctggtccaaagcgtccacaagatttgattccactttctgaaatgaaagaaacgttccatcagcacattgaaagcccagctggtaaccaagggtttggcttagaaaaatcagagctggataaacaaattgaatttgatctagcaaatggtgaaaaagctgtgatgaagacaggtgcgattgcgattgcagcgattacgagctgtacgaatacatcgaacccatacgtcttaatcggagcaggtcttgttgcgaagaaagcaagtgagcttggcatgaaggtgccaaactacgtgaaaacgtcactagcgccaggttctaaggttgtaacaggatacctcgtgaactcaggacttcttccatacttaagagacctcggatttaacatcgttgggtatggctgtacaacttgtatcggaaactcaggaccgcttgcacaagaaattgaggatgctgtctctgaaaatgatctgctgatcacttctgttttatcaggtaaccgtaactttgaaggacgtatccatccacttgtgaaaggaaactaccttgcatctccaccattagttgtggcgtatgcacttgctggtacggtgaatatcgatttaacaaaagaccctatcggtgtcgataaaaatggtgagaacgtttatttcaatgacatttggccatcaatggacgaaatcaacagcgtcgtcaaaagcactgtcacacctgaactcttccgttcagagtatgaaactgtttttgacaacaatgatcgctggaatgaaattaaaacgacggatgatgcattgtacaaatgggatgaaaattccacatacattgataacccgccattctttgaaaacctatcagttgaacctggtaaggttgaaccgcttaaaggcttgcgtgtcgttgcgaagtttggtgactctgtcacaacggaccatatttctcctgctggagcgattggtaaggacacaccggcgggcaaatatttgcaagaaagaggcgtgtcgcctagagactttaactcatacggatctcgccgtggtaaccaccatgtcatgatgagaggtacttttgcaaacatccgtattaagaaccaaattgcaccaggaacagaaggcggatatacaacctactggccaactggtgaagtgacatccatttatgatgcatgcatgcgttataaagaagatggaacaggtcttgcgatcttagcaggtaaagactacggaatgggttcttcacgtgactgggctgcaaaaggaacaaatcttcttggaattaaatttgttctagctgaaagctttgagcgtatccatagaagtaaccttgtcttcatgggcgtacttcctttacagtttaaagacggagaaagtgcagaaactcatggtctaacaggaacagaaacatttgaagttcatgttgacgaaacagttcgtccgcgtgatctcgtcactgtgaaagcaattgacacagatggcaatgagaaaacatttgaagtggttgttcgttttgatagtgaagtcgaaattgactactatcgtcatggcggtatccttcaaatggtacttcgtgaaaaattggcaagcaactaatactcatacagcaaagaagagaaggcgcctagacagctttctcttcttttttaaaatagtggaggatcaatcatgtggaaaaaaggaatggcaagcgctgttttacttgtgttgattggtttacttgtgtggaatttacttgaaccaaaagagcccgcaatcggtcttgaaaaaggggatcaagcccctgattttgaacttaaaaccctagatggtcaaacggcttcattatctgattaccaagggaaaaaggtgctcgtcaatttttgggcgacatggtgtaagccatgcaggacagaaatgccggatctagacgcaattagaagcgaatacgatcaggtcgaagtacttgcagtgaatttaacgaccactgaaaaaagtgaagatcatgttgcagcttttgcagatgaattaaagctgagctttcctattttattggatcaaaaaggcattcaagcacgatatcaggtgctttcataccccacgacatacatattagatgaaaaaggacgtatcatgtctgtgaagcatcaaatgctgacaaaaaaagaaattgagcaagagctggatctataatgattcagcttttttgcttattttctaaatgttttggcgaaaatgaaatacaaacactggaggtgagtacaatgagaagaagaaaacgccgtacatttgaagagcttgtacttgaaaataaaaaagaattattaagcaatgaggaatttttaaaccagcttgaagaaaagttggaagagcgttttagacagaaataagttatgaattgtcctttttcgttcatcctaaagaagagggagggatgaatgatgggtagagagcatgataaacaagcgcagtttacaccagaccatttagggacaaaacctgtagcatacaaacgcaataaaggtaaaaagatgcataataaatcaaatgaacagcctgatgtgatccagacgaagggcgaataaggagggtattaagatgaatgaaaagtcatatcaatccaatccagatgatcgttctgataatgttgaaaagctgcaagatatgatcgaaaacacccttgatcatatcgatgaatctgaagcagcgatgggcctttcgacagatcaagaaaaacagataatcaagcaaaaaaatgaaaatcgaaaaatgagcattgatgccatgcgttctgagatcaaggacgaagaagcagcaagaaaaaatggctatactgaataaaccagggattcctggtttattttattgcctccttttagaagaaccatttcgattgtggtaaaatggcagagaccttaggttttgataggagagcgatgaaaacgtgtatgtatctaaaaaagaaatagaagtccgttatgcagaaacagaccaaatgggcatcgtgtatcatgcgaattatttaatctggatggaagttggcagaacagccctgattaaagaattaggattttcctatgcgcagctagaagcagacggcgctcttgcacccgttatagatttgcaggtgaaatataaaaaacccctcctgtatggtgaaacagcgaccgtgcatacttggattgaagaatacaatggactcaaaacggtgtatggctacgaaattcaaaagcctgatgggcaaacagcgattacagggacaacctcgcatatttgcgtagataaagacacctttagacctattcaatttagaaaagcatttcctgcctggcacaaagtatatgaacagtcgaagaagcaggtttaattcatggcgtttggtattaaaagaagcgatttaaatgcgtggaaatcagctgttcagcaaggagaaatggcctttttaacccattattggcttgatgaccgtttcccgcatgctaatacagtcactaaagcagcctgtcaggatatgaagcagttaattgagtggggagaaaaacatggactcaaaaaagaatggattcacgaccgcgcagggtttcctcactttgacttgatcggtgaaccgcaaaaaagaatcctgcaaaaggagcggtctttaggaaacattcaggagtatgggttatatattgaaggataaaacaaaaaagatacccgagggatgaggtatcttttttgtttattcataatggaattctggttcttttacagactcgttataatcaatatgcagatcatggttgtcaaaataccaaatatcactttcttctacaaagaaagtaataccttctatttcagcggttgcgccggcattttgaggttcatcttttgcgacgccgagagaaaagcctttttgtacattactgcacccgccatatctcacaaaaaagcgaacttgatcacctttttctaaatctaattcatccttgtaccaattgagtgcatcttctttaatcgttaatttcaatgtgatcgccccttttttgaagtcatgctgttttttaaaatgcaggatgcaaaaaaacagcttttctttacttttaccacagaatgaaacttatgaaacggctagagccatttgattttcggttcagttttgttgaggattcgtttgaggttggcgatgtgtctgtagatcacaaaaccagcaagaacggcaacaacaatgattaagaatacgtctttggtgaatatgctgtaaatgaatgtatagatgccggtcagcatagatgataatgaaacatatttactaatgtataaaaataagaaaaaagcagcgatcatcgtgataaataagaacggggcataaaataataacacgccgccagatgtagcgactgcttttccccctttaaattttgcaaagatcggaaagctgtgaccgataacagcagcaacccccgctaataagggatgaatgtccagttgcatgaaaaacggtaaagcagaagcgagagtcccttttaaaatatcagcagaaataacaatagaccctgcttttacgccaagcgtacgaaatgcattcgttgcacctaggtttccgctgccatgttcacggatatcaataccctttgcagctttcccgacaatgagaccggatggaatactgccgagaagataagccaaaataaacatcaaagcaattaacatctgcataactcctttatattctccctcttgtcttacattttaacatgatcttatgaaaaacatggggatctttttttgaaaaaatcaaatgcagatggattcagctttgtttttaagcagaagttcgctaaaatagaggaaaaggggtgtttggatgaatcatccttcgaaacaagaaattggccgtattttaaagagcagtaaacgaattgctgttgttggattatcagatcagccgcaccgaacgtcttatatggtgtctaaagcaatgcaggatgccggttatgagatcattccggtgaatccaacgatcgatgaagcacttggtgtgaaagcagtcgcttcactaaaagagatcaaagagcctgttgatatcgtcaatgtgtttagacgttcagagtttttacccgaggtggcagaagaatttcttgaaatagacgcacctgttttttgggcgcagcaaggcatttatcacgaagaagcgaaaaggctgattgaggaaaatggcaaggttgccatcatggatttatgtatcaaggtggctcatgcaatgacaaaaactcattaaatcgtcaaaaatccttggttttcaaggatttttgcttttttgttgcagaaatatatttgcgattctagaagaaagcgataaaataaggcgacagggacatatcggtgatcttgcatatcaagaaaaagagcgataagataaagatagaacatttgttctgttttgtgaaaatcatcatatgattgcatttggcttatcaaacagtcttgtttataatggacttctagttctcattgcagaatgtagaacattctcatagccgtgcaatggagcatgtttttttgaaccacacatgcatggtgatgatgcagcttattaaagtggacagtaatgagcagcatgatcatcattaaaatctaaagagatcatttgatggtttgccggttatgtttgttagtgaaaggggattaagcatttggttaaaaagcagcaagtagattataacgatgattctattcaggtgctagagggacttgaagcggtccgtaaacgtccagggatgtatattgggtcaacggattcacgcggtcttcatcaccttgtctatgagattgtagacaactctgtcgatgaagtactcgctggccatggagatcatatcgttgtcaaaatacataaagataacagcatttccgtccaggataaaggacgcgggatgcctactggtatgcataagcttggaaaaccgacacctgagatcattttaacggtccttcacgcaggcggaaaatttggtcaaggcggatataaaacaagtggtgggcttcacggagttggggcatctgttgtaaacgcgctgtcagagtggctcactgtcacaattgaacgtgatggatatatatatcatcagcggtttgaaaacggcggaaaacctgtgacgtcacttgaaaaagtcggaaaaacgaaaaaaacgggaacactgattcattttaaaccagatcgatcgatgttcagcgttacaacctataattttgatacgttatcagaacgtttaagagaatctgcctttttattaaaaggattaaaaatagagctgattgatgaacgacatgatgtacaagaaaccttttattatgagacgggcattgaagccttcgttgcttatttaaatgaagaaaaagatgttctgagtgaagtggtctcatttgaaggagagcatcaatccatcgaagtagactttgcttttcaattcaatgacggctactcggaaaatattctttctttcgtcaataacgtgagaacaaaagatggcggtacgcatgagtctggtgccaaaacggcgatgacgagagcctttaatgaatatgcgcgcaaagtagctcttttaaaagaaaaagacaaaaatttagaaggcactgatattcgcgaagggctgtctgctattatttctgtcagaattcctgaagaactgcttcaatttgaaggccagacaaaaggaaagcttgggacaagtgaggctcgctccgctgttgatgctgttatttctgaaaagctggcttatttccttgaagaaaaccgggaaacagccactcttcttgtgagaaaagcgattaaagcgcagcaggcaagagaagctgctagaagagcacgtgaagaagcaaggagcggcaagaaacggaaaaagtccgaagcaacactgagcggaaaattaacacctgctcaatctagaaacccggcaagaaacgaattgtacctagtggagggcgactcagcgggcgggtcagcaaaacaaggacgtgaccgtaaattccaagcggtgctgccgcttcgtggaaaggtcattaacacagaaaaagcgaaacttgctgatatttttaaaaatgaagaaatcaacaccattattcatgcgatcggtggaggcgtcggtgtcgattttaatgtagaagacatcaattatgacaaaatcgtgatcatgacagatgctgacacagatggagcccatattcaagtgcttctgctaacgttcttctaccgctatatgaaaccgctgattgagcatggcaaagtgtttattgcactaccgcctttatataaagtcagcaaaggctcagggaaaaaagaagtgattgagtacgcatggtctgatgaagaaatggatgacgtactgaagaaagttggaaaagggtacacgattcaacgctataaaggtttaggtgaaatgaacgccgaccagctatgggaaacgacaatgaatccagaatcgagaacacttgtcagagtcaaaatcgacgatgctgcacgagttgaacgccgcgtcacgacattaatgggtgacaaagtagagccacgtcgtaaatggattgagaagaatgtcgcctttggacttgatgaggaaagtaacattcttgaaaatgaaaacttgtcgctagctgaggaggtttaaacatggcacaacaagaacgatttcatgatttaccattagaagaagtaatcggagaccggtttggtcgctatagtaaatatattatccaagatcgtgcgcttccagatgcgcgagatggactaaagcctgtacaacgaagaatcttatatgcgatgtacgcagaaggaaacacgcaagataaaaacttccgtaaagcagcgaaaacagtcggtaacgtgattggtaactatcatccgcacggtgactcatctgtttatgaagcgatggtgagaatgagtcagaattggaaagtacggaatgtgctcattgagatgcatggaaataacgggagtattgatggtgatccgcctgctgctatgcgttatacggaagcaaggctatctgcgattgcatcagagctattaaaggacttagacaaggaaaccgtcgaatttgtcgcaaactttgatgatacaagcaaggagcccgttgttttaccagcgatgttcccaaaccttctcgtgaatgggtcaacaggtatttctgctggttatgctactgatatcccgccgcatcatctaggagaagtgattgatggtgtcattaaacgaatcgaacagccgcattgtacggtggaggacttgatgacggtcatcaaaggtccagatttcccaacaggcggtatcattcaaggggtagacggcattaagaaggcctatgaaacaggcaaaggaaagatcatgattcgcggaaaagcggagatcgaaaccatccgcggcgggcgccagcaaatcgtgatcacagaaattccttatgaagtaaataaagccaaccttgtcaaaaagatggacgagttccgaattgaaagaaaagtggaaggaatttcagaggttcgagatgagactgaccggactgggcttcgaatcgtagtagagctgaaaaaagaagcagatgcaaatggtgttttgaatttcttatataaaaactcagatctgcaaattccatataactttaatatggtggcgatacataatcgtagaccaaccttaatgacgctgacaactatacttgatgcatatattgcccatcaaaaagaagtggtgacgaatcgctcagcatatgagcttcgaaaagcgaaggaacgccaccatattgtagatggattaattaaggcgctatccatcttagatgaagtcattgccacaatccgctcctctaatgataagcgagatgcgaaaaacaacttgatggagaaatatgactttacagaagcacaatcagaagcgattgtttccctccagttatatcgtttaacgaatacggatattacgcaattaagagacgaagcgagtgagcttgatgtgcgtatagcagaacttgaagacattttaggtaatgagaaaaagctgcttaaggtcattacaaacagtttgaaaaagctcaaaaagacatatgctgatgagagacgatctgtcattgaggaaaaaatcgaagaaattaagattaacctagaagtgatgattgcctcagaggatgtttacgtcacggtgacgaaggatggatacatcaaacggacaagccagcgctcctatgctgcttctaacggtaaggactttggtatgaaggatacagaccgcctgattcatcagtttgaaatgaatacaacggatgtcctcctactattcacgaataaagggagctacatttattgtcctgtgcatcagctgccagacatacgctggaaagacatggggcagcatattacgaatatcatttcgattgatcgcgatgaatccatccaaaaagccattccaattaaagaatttgatgaaacatcgtatctgctgttctttacaaagggcggaatggtgaagaaaacagagcttcttcaatataaagcgcagcgctattcaaaaccacttgtcgccttgaacctaaaaggggacgatgaacttgtggatgtccatgtgacaacaggacagcaggaattgtttattgcgacgaaaaatggttatggattgtggtttgatgaagaagaagtaagtgttgttggtccgagagcggctggtgttaaaggcatcaatttgaaggatggggacgaagtagtctctggccagatcattgatccgaaaaacgatgtcctcgtgctgacgacgcaaagaggggctgtgaagcgaatgaacctctctgaatttgataaaacatctagagccaaacgcggagttctaatgcttagagaattaaagaaaaatccgcatcgtattgtgtctgtcatcgctgcatcactgcatgatacacttgagattgacacagagaagggtgcaacgattccgcttgagatctctactctgagagcgaatgaccgctatagcaatggatcatttattgtagatgaggaagagcagggagaagtaacgcatgtccttgtcacacctcaaactgcaccagatgacaataaataagcaaacgaaaaccccctgcgatgagcagggggttcttttatatacaggtctttgtcttagctctcgtggttgccaaacatgcttgtaatggcgtgcactacttcaattccttggtagacgaaaagagaaagtgaagtgacagagaataaacctagaatgaatactcttaagaaaaataacatcgtgtaaaacctcccaattttgttttgatttagatggttgggttaaacacgagatagtcggaaataagaagattgatagaacactgcaagtaaatgcttctttttccggtcatattgatcagtatgagtgatgcgtgcaaatccagctgtcatactgccaattatcagcagtactgtaaatgcggcaaatactgcgctcacatgtttttgtttcttttcatcgcccatggtctgagcgattttcatctcatgtgattcttgatcggcaaccacctttgcatggtggtatacctgaacggaatgaggcattgagaacaaatgaaaacttgcgagtgctatgaataagacagctaattttagcagcatattttttttcatttatctcaccccttcctgtttattttcatgatcttaccacgttttctgttatttgaaaagtcttatttttttactttccctctttaaaaaagcgataaacatcaggacatttataggactgtttcacttcatgaaaggtttcaattttatttttttaatttaaaaaaagtgccatgatcgaggaccagacacttttagtgaacttgtgatgtatgcggttttgcgacagcttttgtaaagattcccgcaatacatatggcgaataaaacaaaaataaaggcatgaagcagtcctacttgattggcaagcagccctaatataggcggaccagaaagagaggcggtgtaacctgataaggtcacaatgctgacgcgtttcacggcgtaccggctatcatcaccagctgcagaaatagttaacgggaagcctaaagaagccccaagtccccataaaaagatcgatatcatacataccacaagtgaaatctttaaaatgaccaaaaatagtccagcagcagctgatacaatcgcaactcttagcaataacaccctgccgaaatggtcaatcaaacgtccgctgattaatctgccgctaatcatcccgcataaaaataatgcatagatgactgtactcatggaatgagaaacctggtagccatccaccattgcaagtggaatccaatcattagcagacccttcgacaaacgcaagacataaggcgatcatggcaagagagaccgttcgtttattcagccacggcgtttgagtatcatctattgtatctgactgcgactgcttctcatgctgatccattccagtcccgtgcggaataaaccgagtacaaatgaagatgctgagaaagaaaagaagggcaatgacaagtaagtgattcaacacagagacccctagatggataaaaagaatgccagctcctgctccaattaaagtaccaatgctaaaggaagcgtgcaatataggcaaaatggttttcttgattctgtattcaatttctgtcccttctaggttcatcgccacattgcacatacctgaacctgctccaaaaagaaatagtccggccgtgacgacaaagatagaagagagggttgaaccaatagcaagagtggtgaatccaagaaacatcaaaaaagcactaatcacaatcgccactcgtccgcctttttttcgaacaaatacatttgaaagaacaagcccaacaattgaaccaacggataggccgagtaaaatgagtcccatcgttcctgtattggcttgtaataaatctctcacttctggtgtccgtgaaaaccatgtagatatggaagtaccagacatcgtgaaaatgatgatgattgctttataccactttaattccatgtaatccctcacatttaaagatgtatctgttactgaacaaatctactcgattataaatgagacggaccaattcgtaaataacctgaggcaggaacaggggcaattttaggcaaaagaaatcatactttcccaattcttctgaggagaaggtaaaataaacataaaggggatgtatcaggataaatagaaggagagaggactaaaatatgaaaagtgaaaaggaaaaaatgatccaaggagaacattatgtatctagcggccaaaccttgatcgcagatcgagaaagagcaagacaattgcctttgcataccagcaaaccaacattttaaaggaattattagacacttgcggaaatgatgtcgttttcgaaggaaggcttcagtgcgattactgatacaatatcgaggttgacgagcatttttttgcgaattttgatgcggtgttgcaaaattaccattggacatcattgtttattaggatcgaatgtacgtatttatacggctggacatccgctcaatagaacgtgcaaaaggcattgagttcgtattattaatccaggtgtcaagattggcgacaatgcggaagtcattaaatatctggatgaatcaaaatttggcgaatatcgtagattgtggattttttctttttcgtctcaataagataagtatacttagatttgagacaaaagaattgtattcgttgtataacttcctagaatatatattatgtaaactaataaataaagatataggctgaccccccaactggtagccccttcacattaattccgtaatcaattgaatggttatgtcttatctattaattaatgcaaaaaaagagagcctttaacttggccctcttcattaattgtatttgtctcaaacttagcacctatttctcagtctcagcaaactgtttcaatcgatctccaatttcatctcttaccctttggaaaaatgcccatttctcttcttctgttccttctgcttttgctggatcatcaaagccccaatggacacgttcgacatgaggaggagtcatcgggcatttatcagctgcatcaccgcatagtgttacgactaaatcagcgtgatgcaatatcttgtgatcaatcaggtcagacgtttgattagatatatcaatccctatttctttcattgcttttacagcattcggatttaatccatgagcttcaataccagcgctatagaccttccactcatctccaagatgttttttagcccaaccttcagccatttgactgcggcaagaattaccggtacataaaaagtatattgttttctttgacatgttgattgtctcctttaatgtataatcattagccagaaatacagcgctaaaagtgtgatgaatagtgttggtacagttaaaatgacccctattttgaaatatgtgccccaggaaatcttcactcctttttgagaaaggacgtggagccacagcagtgttgctaaggagccaatgggcgtaatttttggtcctaaatcagagccaatgacatttgcgtatattaacgcttctctcatcattccttgtgtatcggtgccggatatggctaatgcatcgatcatgaccgtcggcatattattcatgacagatgaaagaattgctgcgataaatcccataccaagagtccctgccaataaaccttgatctgctacagcttgaatcacgcttgaaagagcatcagtaagccctgcatttcgcatgccgtagacaacaacgtacatacctatggaaaagaaaacgatcgcccatggtgcttcttttagtacgctttttgtttgaacagcagggcttttttgtgcaaggattaagaaaaaaatggcaatcacacccgctatgaacgatacaggtatagataaaaattcacttgtaaaataaccaatcaacaaaaaagctaatatataccatgataatctaaacatctttggatcttttattgcttcattaggttgctttaactcagtcatatcatagcgtttaggtatactttttctaaagaaaaggtacagcacagtgatactcgcaagcaatgaaaaaaggtttggaacaaccattctggttgcatattcaataaatgtaatgttaaaatagtcggctgttacaatgttcactaaattacttacgacaagaggaagcgaagttgtatctgcaataaacccacttgcgataataaaagggaatacaattttttcattgaagtgtaatgctctgaccatggctaaaacaatgggtgtcaaaataagtgctgccccatcgtttgcaaataaagcagcgacgattgcaccaaggatggtcacatacacaaacatacgtagcccactgccttttgcagcctttgccatatgcaatgctgcccattcaaaaaagccgattcgatcaaggatgagtgaaatgatgataatggcgacaaaagctaaagtcgcattccaaacgatgcctgtcacggtgattacatcgtcaacattcacaacacctacgattaatgctaaaatagcccctccacatgcggaccaccctatggataaattttttggctgccaaataaccaataccaaagtgaacagaaatataagtaacgataaaacggcaaaactcaaactcatccctccttacgaacaagaaatgtttgttgctttatgttgtatactttttaaaaggtcatcttctttatcaatttgatttaagatgatccgaatcgtctcaaattctggagacagtgaattgattgaataataacgccactgcccttttctgttctcatgaacaaatccagctttttttaattttcgtaaatgctgactaatagctggctgactcatttcgaacatatctaccaattcacacacacaatattctttctccaaaaacaatttcatcatgatcagtcttgtttgatcactgagtgtttttaaacaattcgacatatgtgtcacaccaattgaaacatctgcagtcacaatgattaccccctcttttcaaaaattggtgacggtcgtgttattaactcctccaacagtatataactaaaatcttatataatcaattgattatatgatttcaaacaaaaattgattcgtgtgaaaatgattgatttacttcaaatgaaaccacatatttatttaaatagcccagttctccatattggcaaaaaaggtgttgataaccctaacccaataaatgctgaagggattatgacagaaaatgaaaaaagagtggctgatcgaatggcattcctgatattttaaatcgcggatctgactcagtatcagcattaaacagttgcagcagttggcagtgggcattctgctgttaacacttagctcgagctgccaaagctaaaagagacatcaaaaagcacagaaatgatatggattttaagaaagcaggatattagtgaggtattaagaggagaaaacaatgatcaattgcctgcaagaggtcaattagatggaaaggacccttctttgtgtcctttgatcagaaggtgaaagagggtccattaataaagatacagttattgtttcgactaattaaaggacccttgttcttgtcttggtacaaatcagatagctcataaaggtttttggggtaattccattatttgaatctccatcccccatgaagttgtgatatagaaaaatccaagagggctcagctctctaactttaacatcaggctgttctgcaaaatattttaaagcctcttctatactggtcactgtaatagctagatgagctacaccgatatcactgggttttaggtgaacattctgttgatctggatctggcgtcgaccattgaaccagttcgatctttctaccgccatattgcaaaaatgccgccccttctacaactgaatgttcgtgaaccccaaagtatctctttaaactatcgtcttcaaactgcatccgtcctggccggaacaagacttcaaaacccaaaatattagtgaagaaatcaactgctacttcgatatcgggtactacaaatcctgaatgctcgattgtgccttggaaaattgtatttttcatatcgctaaacccctttgattttttggaagtaaatgattcatgataaagtggtatttaaagcagctatatcacacgagcaccaattaggttcaatacaagtcaagtaatgttggcactattacaagatttagaacaacaatacctgagccttgaaatactataatattcttttgtgatttctgaatcttttttgaatatccattaaaatttacatgttccatctgaacaatcatcatcgagcgacgactctgatttatgctcttcaaccttagagttcgcatactcttctttccaaacctgttgtaatgtttctaaaaatacttcactaggctgtgctcctgagatgccatatttatcattcactacgtaaaagggcacgccctgaatcccaatttttgatccctcggctctatcagctgcaatattctcgctatatttatcatttgctaaaacatccaaggcttcgttgccatcaagacctatctcacttgtaagttgagcaagtgttgcatggtcaccgatatctagtgaatccgtgagatgagctttcatcatacgctccataaactcctgtatcttccctttctcttttgcataataagaaagacgaagtgcatcatatgaattcgtaggaatcaatgtatcaaattgataatctaacccaacctcttttgctttctgtttcaattgattgtttcttgcttttgctttttcatatggaataccatgcttggaagatgctacttgatggatatccattcctgtatttttttttgcatatggatctaattgaaaatgacgaaataagacttcgacctcttctttatgttcaaactgttctaaccctatttcaaattgacgtttgccaatataacaaaacggacaaacaaaatcagaccaaatttctactttcatcatatgttccccctttatgattttgatgaatgtgcgagggggattatgttaataacatctttttaactaatcccaccaaagctcttttttaaaaagttcgtgctgccgcttttgccttttcaattgctgcagcaacaacttcttctttcttagttggatcatagtcaataccttcaacaaaaatcgttggttccacttcaattccaacaaactttagcgcacctcttacgtaagattcggaatgttccattccaattgcctgtgaataaaatcctcccattccatgaatatggattgcttttttccctttcatcaatccttctggaccttctgatgtatatttaaacgtttttccagcactcatgattgtatcaaaataggcttttaataagggttggattcctaaattccacattgaagactgaatgatgtatttatctgcttccataaattgctttgtgaatgcattcactgcttctattttttgtgcttcaacatctgttagcacttccccacttcttaacttcttttgtccagttaaaaaatcagcatcgattaatggcacatttgcataatagacatctacctcaattatttcatccgttggatttacttcctggtattcattgataaatgctctagcaacttgcgtacttcttgattgttcctcactttgaggtgttcctttaacaaataatacttttgacatgatcatttcccctttatgattttgatgaatgttttttgttcctaaacattttttgaatacttattaaaagaatttacacgtttcatctaaacaatattttcgctatgattcctataatttctgctggatcaacaacctcacacaaaaagctgatttaattattatagacaatgggcatttttccgattaattggctttgcctagctgcgtcatacatgagtttagcgacattttctctagatacggacattttagctggctgatcgccgaatgaataaccgtaagattgcccgttgtatttgatattaggattaatgattcgaacgactgtccaatctaggtttgattgtttaatcagttctcctatcttcttcatttcggcataaccatttggcatgagaagtttaggcaatattctcggcaatatcgtcgataagcttttcttatcgtcctcagattgcaaggctggcgttgcgagtgtaatcaatctttttttggtgaacttcttcatcgctttgacaatccgtttatgtccgtcggcgatcggtgtaccttttcgttttcgcgacaaatcaatgccggggcctaaggtgcttaacacgacatcagcttctgaaactgccgtttcaatggctgaagtgttcgttagttcacccgttacaatgcgtaaattcgaatgctttcgcttgattttctcagggtttctaacatataccgtaacgaaatctccattttctaatgcaaattgtgttaaaagttgaccgattgcaccagttgccccaaaaatagtgatgttcatggtcttctatctccttttgttattctgaatgatcacaattatttccttgatcaaaactctttcgtaataacatgtgttatttaagcaacgcgcgttgtataattgatgataagatgaaaaagaataataaacaacaaccaaaatagccgatatgttgtttacgcaacacttctatatgtattgtcgtttttagacacgatgatgaaccctaaaaggagaagaaaaaatgattatgccaaaaaaagatccgagaatacttcgtacaagacaattgattgtagactcttttctttcgttagctagtgaaaaagatttcaaccatataacggtacgtgatatcacagaaaaggctactattaaccgcgctacattttatgcgcactttgacgataaatttgatttattacattctacaatcaccaatacatttacagacaaattgaaaaaaagactaaatgatcacgatggattcaatgaaaaagtcattggaaatatttttctagccatgtgtgatcaccataaagagttaagcgagctatgtcccaaaggttataattctttaggaactattatagaaagtaaaattaaagaggagttacagaaactaatagctgatcttgtgctaaaaggaactgaaaataccattgaattagaggataaacatttggtaacaaccctatctactatgctaagttgggggatatacggagctgcatacacatggaataaggatggaagacctatttcaccagaagagctagtggctaagaccctgcctatctttagaaatggtatgagtaagtattttctttaatgaaactgatgttattatcaattattttagccattttaaagcagcctattattaaattacgcaaaaatcgatattagcataaaacagcttttgtaattggcagtgggcattctgcttgagctggcagagctaaaaaagatatcaaaaaacacagaaatgatatggatttaaatagtggggtatttggaggagaaagcaatgatcaattgcctgcaagaggtcaattaggtttactttaaatagtgggattcttatacggctattgtttatcaggtcatacaatggatctacatttaccttcttgtaaaagtctatcctcttgtttgtctaaatctcgcctctttcaaatttaaaacttctacgaccttctcaataaattaaatcggtcgtagaagttgggccttatttgttgtactgtaaatcaaatattttgggatatttcttttaaaaattgctttctcttttcatctgttgttaagttcactctagaaaaatgaatccatttcgtggattcatttttcattcccaaatcagctagagttctattaataaaaacgctttgaatggcatttccagcttcagattcaatataatccttatctgttgtagatgttgagatcacggttgttttttttatatttgtcaataaacctttcaaagaaccagtgtgttgatcttccgtaaatgcgaaaccccttaacatcactttatcaataaatccttttaaaatagcaggtaaatcccaccaccagacaggaaatataaaaatcaattcagttgactgatttaatttttcttgataatcctttactaattgataaggcgtttctcctttatgaaaatacttcaattcttcagctgtaaaaacaggattaaactcatctttatataaatcgattacttgaaatggttcttgctttgtttctagattttctgttatggaagtcaaaatggcatgattataacttccatcccaaggatgtgcatagacaatcgttttcattattcattcaccctttttctgagttttgcatcatattttgatgtacattcattttattgtatgctataacatactacaagtacggtaatcaaagtgcgatactaactcaaaggagagtgtaaaatgaatgaggagtccttccagacgaaagctgagctaaaagatactggttttgagtatactttgtcattaattggcgggaaatataaaatgccggttctgtatgctttatatactaacggtgctcctgttcgctataatcagctgaaacgtatgctcggaacaatttcgtttaaaacattaaccaacacactaaaagaacttgaagcggatcacttaattcatcgtaaagaatatcctcaagtgcctccaaaagtagaatatagtttatctgaaaagggattatcactgatgcctgtattagatgagatatgttattggggagaggaacaaatgaaaaataattaggtagactggaaagaaagctactacggtttaaacatgctttctaaagtagctttcttctcatcttatatcaatcccattggctcattttgttgatgtgctaactccattccttctgccagatagagagcgttcttcttatctatatcatcatcagggcaattgtgaatcagttgacgcaatctaactgcaacggtcttacaaacatctggcattaagtaactgtcagaatccgaaagattcagcaaaggaatgatgtcatctgtaaagttctcaaatggtatgtccccgccaaaaccctccatatcatctaaattcataccgatacatgctgctaacttgcatctaaaatcatggaagtcggtgtaagaccaatgtgattcgcaatgagtaaaatccaatcccacgattcattcctccgttttcaaattgtgatggtcgatattttcaacatttgcaaaaattactcctgattgatcatataataggtcaacgaggcacgcaacgctctattctaccaaagtcctaaggttattttgatttaattcctgccccgcaaagaggtatgacaatggtttcttctggtttcttttgatatttcatgtagccagccaaattgactgcagatgtcacttcgacataaaatcctttctcactcagtgtagagcgtgcatgtaagatctcatcttcttcaatatcaataaacgtaccattggtatctagtacagcttctaaaatttgtttggagcgtgctggagcagcaatggcaatcccttctgctaaggtccctttattcgtcacaggtgatgctgattcctcttcattttgatatgctttcacaaggggtgcacagtttttcgcttgtatggcaacgattttcggtattttatgaatgaaaccattttcaaataactctttaaagccataatacgcacctaggaggagagtaccgtttccaaccggaatgattaaagcatcaggtactccttttagctgctcatagatttcataggcgtatgttttagtcccttcaaaaaagtaaggattatagacatggcttgcataaaacacgttttcattgtctactgccttttgtgccgcagctgcaatgtcctctcgcgtcccgttaatttctttaatcgttgcaccatgtgcttttatttgagcgacctttttaggtgaagtgtcatcgcttagatagatgtcacaggcaatctcgcagcgtgctgcataagccgcaatcgccgttcctgcattcccgctactatcagcaatcacctttgatacccctaattctttagcctttgtcattagaacagcggctcctcggtctttaaaggataatgttggcatcatgtaatcaactttgacataagtgtttggctcattaggatctagaacgattaaaggggattgaccctcccccattgtcacagtttcccacgtcttagaaccttttggaaatggcatagtttcaacataacgccataatgaatttggatagtgatcccaagctgcgatatctattttcggggtatctttcaccaaatttaatactccaccacaatcacatttccatagagttggtgtcatctcatatttgttcccgcaatggttacaaatcaattgattcatcaatcattcaccccttcgaatatttttttatacgaaatataattttttatatagagtaggcaaaaaaatatcttaaatatatgcaatggcatccatttcaattttgaaaccaaaatgtaattcattcgttggtacaatagtacgtgctggtttatgttcaccgaaaaattcagtataaacagcatcgactttgtcccataaatgaatatctgaaatgtataatgtcatgcgcaaaatgttctcttttttactaccagcagcttctacaatcatctctacatttttaagcgcttgtaatgtctctttttcaatggggccgaattctttttctctcgtttcgggattgatggcaaattgtcctgaaacatagactgtgttttgatgaatggttgcaaatgcatagtgtccgtttgcttttagatttcctacctcgcgtatgctttccatttttgacactccttaccttgatttatttttgatttcatccaaatagctatagacggttactttggaaatgcctaacatagatgcgaccttctcaacagatcctttcattaaaaaaatgcccttttcatccatgaatttcattagttcaattttttcatgacgtttcatgactggatgaacactgttttgaatgatctgttgaatcaactgatctactatttcttccacattttcaagatcatcatttgatgttgtttctttctcatgagcttccacttgtgtagtaagaaaagtatccataaattgctgcatttgattcagtgcttcaacatcaaagttgatacagaaagcaccgatcactttttgctttgaatcacgtattaatgaggtcgaagaacgaatcgtacgtttatcttctgttacaaatgtataaccagcaagataatcttctttaaaattttctgattgtaatacagtctttactaaatgatcaaatgattgaccgatttctcttcctgtcacatggttatttactgtaaacatgacagatgcttgagggttcgttaaatcatgaatcaccacttcacaatttggtccaaacatttttgcagtagattttgctaaaggaatataactttctaataactttttaatatgttccatgcctaagcacctcatttttttattccactagattatatatttttttatatataaaaacaatatatagatttatttatatatgtatcatgatgctcacaagatcaaaatgtgaaaaaaacatataaaaaaagcagccattcattgactgctttttgcttgtgctcctttctaattgatttctttctggattccatacaaaatgacgtcaattccccatcggaaccgttccattgaaacggtatcacctgcaaacatttcttcttttacacgatgaatgaaaggaaaacgcgttttgtctgcatcatcaaatgtttttttaatgtctgaaatctgcgaagagccttgtttcttccaagataccttttcgtatgctacggaagatacgtataagagcaataggtctactccccatgctgcggatgtagatttgatcccgccttcatgcaatgcagcgagaatatgttcggtcaactgaagaaagttcgttccttgtggaatggtggaaagagaaatttcagcgagaccaggtttttcgaatagcagtaggaaataagtatgcaatatgtcaaataactgttctttccatgtgccatcctctgcatttggataaaccatttggccgagaccataatccaatacgtaagcactgagttcttgaacattgttcacgtagacatacaaggatgcaggtcccgtatccaatgctttagccaccttacgcatactcatgccctctatcccttgctccttaagaagctcataggccgttttcacaatcagctcacggcttaagggttctttagccggccgagaccggcgacttataatacgacgatttgaattgttcatactctctttataacatgtcaaagtaaaatagtaaattgagcatcaatcaccgttttcttgaaaagaattcatcatatctgcaagcttgaccgcagcgtcttttgaaaaacacagctttaaactatactccgattcacgagccttttccgatgaatattcgtacatcatgtcttcgtattcttcaatagctttttcaatatgatgaggatgtcggacaatagcaagtgccagctcccttgcatcaaacatcgccatgttgacaccctcgcctgcgaatggcgacatgacgtgagctgcatcaccgataagcgtcactcctttatgacgattccatttaaaaccggtaggaagcgtataaatccgtcttggaatgatggcatcttctgcataacgaatataatttttcagctgatcatcccaatcactaaataactctaataattgttcttttgcttctttcgcttgatgaaacggtataccacaagtctcgatccagttgcgttcgaccataaggcttgcatacactttgattcgtccatctccgtttaattgaccaatcagtcctttgtggtctgctaaagcaaacatcttaccacgtttattaaattcagctaaatcagggtggttctcctctacgcttaagacattcagttccagcatcgtgagcccagagtatccaatctcaatatctgttaacagaggacgcacacgagagaaagcaccatcagctccaatcaaaaggtcaactgtctcgacaaccccgttttcaaaatgaagctccgtcatgccgctttctaatgaaacacatctttctaatttgtatccatatttgatgttttcagcatcaatttgatccagcagcagttcgcacaacacaccacggtcaatttctggacgagtgcctttttgatctgattccgtttcttcatctaaataaatttttcctgatttattaagtaatcggaaatcttctccttcataacgggcatttctttgaaatttctcataaactcctgcttcttttaaggctttttgacctgtttcttcgtgaatatccagtgagcctcctcgttcaagactcttgtcatgaatctcccgttcatagatggttgtttgtataccgtaattttgcagaattaaggcgagtgttagtcccccaggtcctcctccaatgatagcgatttgcttttgatccttagataatgccgtcatcgtatgcatctcctcttcctttatggaaattgtttaaaactacatctcatttgtattataacgaacatcgttcgtaaagaacagtgttcgtttgaaattgtttgtttcacgattgtgttttaatgaaaagaaaccaatcgcccgccatcatgtgatacactccatctaggaatcttaaagatttccattgttcaaactctgagtgtaagaggtgtttctatgaataaattattggcaatgttgatattaggattgggctttagtggtgccgcgcttattctttctgtccctttgttattcaaacccaaaccagaacaagctgagctgttatttgctgctggatcagcgggggctttcgcagtattcgctgtctcatgcctaattcttcgaaaacgattcaatcgctaaaaaacctaaacaaaatccaccgtcatgaacagtggagatttgtttaggtttttgtggttttttaatatgaatttaaagaatgtggtataagctgacaccgatactgagagcgaataaaacaagtgcagggattgcttttttaaagggatctttggccaatacgatcagagtaaatgcagctgccagcatcgtacctcctaacaataagcctgataataatgctaatgttgggatccatatgccggctagcattccagcagcgcctattaactcaagagcccccgttaaaacattaaaaaatgcaggtaaaccaaattgtttgaactcttctgccatttttccagatatgattttcgttcctgtgaggaaaaagaaaacggccaatacaatttgtagaataagaatgaaaatagtgatcacatctttctaagttatttgaccagaaagggtcgcttaatagacaccggtttctggggccatcttgataaaatctcacttccacattgaatggatgaaatttatatgtcatagcatatatcttgcaaaaatagaggttgtttctaccttatagatttatcaagatggatagtctgaatagaataatttgtttaaaagtaattttaattgttcaatctcttcatcacttaattgatttgtcacagttcgatgtgcatccatgacgacaggaagaatcgcctttttgatctcgtcccctttttctgttaaaaacaggtgatgcgagcgccggtcttgttcattatagatttttttgacaagcccttttcgttccattgactggatcattcttacgacagtggtttgatttttatcaatgccttctgccaattctttttgagtcgcgcctttttcacggctaagaatactaataatactccactgctctggtgtaacaccgtatggctttaacctattcgtaaaataattcgtcattttcacatcagtgcgatgaacgagataacctattaaatcatgtaacttcatgtaaacaccctctaattattttatatgctatagcatttatattagtggagcggttaaacattgtcaaattgtctacatgctatgcttaaaatcaattcctgacatgatatatggcaatgctgatttgataaattcttctgaagatatgtgcgaactattttttctccactcaacagaagctccgtgaattccccagcttaaaaaaacagccgtgaccttcaacacttgcttttcgacatttgtatattgattcactaacaactgataaaaaataatttcaagctgttctcgaacaattggagcaagttcagtttcatattctacttggcagcggttatgaagagattgttggaaactggctagcgctttaaaaatattcatcattgtatcttcatctagtttactattgttaaaattgatactttctaaattaattgacaatacttctgagagtgttttatctaataaatcgtatttatcctcaaaatgataataaaacgtggctcggttaatcatggcttctgctgtcaaatctttcaccgtaatatccttaaattcctttttcgatgaaagctttatgaaagactccatgattaatttgcgcgttcttaatatacgcggatctgtctttggctgcgtcatcttcttccccccttctttttaaacacatgcttgaatctgtcggataaacaacaaattgaagaaattattggtattgatctcactcattctgtcttaagattcaattgtaaagcaaatgatgacttgattcaaacaactgatcaggacacattttttcctgaaaaattgaggaggaaacaacttgaaaaacaatgacatgttttgtgatttagaaactggtgtatgcggtgtaggtgaagaagatattcaggtcattgactttcaccaacctaaaaaaaacattacgctctactatgtaacagatccgatttgttctcattgctgggcaattgaacctgtcctgcgccgttttaaagaggaatatggacattattttcattttcagactgtgttaggtggactgctagagaaatggcatgatggtccaattgatcctgcaaacggaatttataagccggctgatgttgcgggtcactggagagaagtcggagaacattctcgcatgccaatagatgggtccttaatgattgacaatcctgttcaatcctcctacccatcctctcgtgtgttcaaagtgattcaaaaacatcacggtgatgaacaagcctatacgtttttacgccgtgcaagagaagcgctatttgcattcaatcaaaatatatcggatatcgcggttttgattgatatcgttaacaaccttggactgaacggagatgtgattttacatgaagcggagctccctagcggacaagacttattaaatcaagattttgctcttgttcgagacctcggtgcaagaggttttccgaccctcatcctcgtcaacgaagaaaataaaggagttaaaatcacgggtggtcgaccattagacgtctatattgatggattaaagcaagctttaaacacagaagagcttcaaccgaagaagctcccagtggtttctgccttactcgaaaaagaaaaatgtctattctctaaagagattgaagtgatgtacgatgttgatcaatcggatgtgcggtcttttatggagaaagaactttcacaagtaccgtttcatatgaaagaagctctaggagaacagtatttcacaacttcaacataaggagaatggcgatggcttacgtattacaagtggattttaagatgaatggccctttcggagatgaattggcaaaagagttttctgatttagcgagaagtattaatgaagaggatgggttcatatggaagatatggacggagaatcctgagaaaaatgaggctggcggaatttatttatttgaaacaaaagaagaagctcaaacatatctcgatatgcattctaaaagaatcactagcttcggcataacagacatcaatgcgaaaatctttgacataaattctgagctgactcatatcacaaaaggtccattaaaaacgcattaagattaacacaagaaaaaagagcggttgttgactgctcttttttcttatgaatgaagtaagatattcaactttaaaccgattcattaaaaggttatgatcagcagtttcccctagctcacttgctgcttgtttttttaattaattctacaccatcatatgatagggtttctacatgtgtagccttttgcaggatgtaatgatcaaaaaacgtcttcgtatagtccgtcacaagatgatgcatctctaatgtatcccttgtgcctttaagttcctcatctacaccggtaaacacgatgtcacagtaatctaaatgtgcagcaccatcaacagagaaataataggtttccatgctgttgttagctccaatgattgcattcatatcataattcggttcagaaaacagcagcaaaaaaggtttgttgaggtcactgtcgagaaggccgaatgcaccactatctaagccaaccccgcaggcaaaccggtcgtcatcccggcaaacaaaagccgctgtaggtccgccataagaatgtccggcgatacccatgccgatgccgagcagcagtctgttatgaaagatggacttcgattctccagagtctagtttgtgaagataatcggctgcgtactttacatcttcagcctgttgttcactatatcttgttaactcgttaatgattggtaaggaaaggacgttacggcacatctcaatagccgtttcatcgtcagaacgcatcttcatcttaccagctagcgtcatcatctctggatcttcagaaaacgccataatgacattcgaaaaatcctttgatacattcaacagctgcccatctttgcgtttatacatggtgctattctgatggccgatactgacgacaacatatcccatgcttgctaggtctgagcagagtactgtcccccattctggtgaaccgcccccgccgcaaacataaaatagtactggatagcgctctttcttccgagaaagagccacatcgtcataacaatgcgtttttatatcgatagagaagaagtttattttcttcaaatactcagtgacaagcggctggtcatgaagcatttcgtagacttcaggaaacatgtacgtggatggagtctttccttcgctgctatcagatggatagtacataaatgcggtcagttctcttttcgaatgatctgatgccgtatactcaaaatccatctggattcggccggctatatagctacccattggttttgggaatgtgtcataccttttcattcttttatgcccctttcatcttgaaaatggatatctgttctttgctgggtgagtatcgttttgtgatataatctggagtcaaagacaagtgctaagagaaatgaaatgaacttgctgaatggaattcttgattgtgaaacattctgaagaaatgatagggtgatagcgatgagaagacttgagtctggtatatcaatagacaacgaaatgttttctgatgttgccaggtatgaaaacgaaacaatcagtagaacgacaatcatcaactcaaatgttcgttctcctatattttggagctgtcacctgcatcatcttgtatttgatacgtgtgatctcacgaatgcgagattttttgctggtactacgattgatgattgtacttttagtcgttcagacttgcgctctgtgggcattgccaaaaacgaagctgtcttcaccaattgtgtgttttcttcttgtgatatgagaggaatgacattggagaatgctatgtttatcgattgtactttctctaaatgtagattcaatgaccgcgtattacaggcagcgaatatcgtcaattgtacctttgctggtaagctaatagatataacgtttgagggaaatggcaaacaaaagctgatcgccaattttgaaaactgcacccttgacggtgttcgttttacaggctgtgacctagcggcatgtattccgccagcatccaaaaatcatctgtatgttgaaaatgtatcttcacgtgtgaaaaaggctttggagaagatagatgatgatcctactctttctgacgatgatcgtaaaatactagtgcgcagtctgcgcaagcttgaaccaatggaacagtatatgtttaacacgaaacatatggagaaaatatatggggctgcttttgttgagcgatttttcagtcatcttggatgcagcaagggcttactaccatatttcttctatcgtcttcatctgaataagggtgtctcactgcaacaattgtatcaaaatcctttatccatccgataaagcgctgccaatcgtaatggcttctggatagatctaaagttttcatgaaaacaaaaaattatgtttacacatatcatcttcttatctatttttatagcgatgaatcatatagcagatcatttttgtgatgacagaggtacacatgcatagaaaagtcatagcgatcacccaatacatattcgatatgtcaaaccccgtataggcaaagataaaaacggttgaagctgcaaaggtgattattagaacgatgtagacccgcttaaagatgatatagcctacaatcccccatattaaaaataacaaaggcaatgtaaataagatcagagccataggttgaagaaaagaaacactcatcattcactctcctttactaaccagccatttttcaccccaatgaaaaagcgaacaatcattatattaatgggaaatacgctcattgtaaacaaaaattggaatttaatgaagcggaatctgtattgaatggacattgtgattgtatttaaaaagactgcttaagggaagcagtctttttggcgtgaacggaatccctaacgattgatcacctgaataattttcttctgagcatcttgtgcctcggggattggcatgacaacaaacacatgcaacatttcaggataaacaaaggttttgatgtccattccttgttctgttaggttttcatcgagctttatggcatctggatataacatatcatgtgttccaatgaaatgagtaatcttcgcaactcctttgaagtcaccgtaaatgggactaatcaatgggtcagttacatgttgatcagctgtccaaatctttgcaatgacttccattccttcatgacctagaatcgggtccttttttgcatattcaaacatgagaggattgcttaagctcatgtcgacacatgcagataataaaataatatccttcggctgtggcagattcttcttctttaaaaggtgcgccagaccaagtgagatgtttccaccagctgaatctcccatgatcgtcaattgattggcacttccggcagttttcagaaggtctttatataggttaagaattttcggatacgtatcctgatagctataatgaggcacttttggataaataggagcgaccactttcgcacctagtgattgcgccattttatccatgaaccaccagtggacattcaaaggctgatttgtccatgcaccgccatgtagatagagaatgactttttggttttgtgatgcttgttcatttaatgtgaaaacttgcatgccttcgaatgtttgctcttgtacctcactcattaacttcacatcatctccaatggcataaggctgcgtattttcaattcccttttgctcaagaaatttttttgtgtgttcgatactagaaaaactctctttattactttgcgaagcgaataatgtttcaaattgaatactttcttcagaacgttcaccatgataaatttctacactcatttttttctctcctttcactcaatatgatgattgatcatcctcatttggtacacgaaatgattctaggtagacttgtacttttttttcaggggtctgtaataagttagataaaaggtcttgaatgagacgaaggcttttaattttcttttcaatttcttcatgtttaagatggacaatttctcttagtgtatcaagttctatgtcttgacttagcatgtccataatttcagctatttcctttaatgaataacccagcgttttcgcatctttgatcaattgaatcttcacaacatagtcttctgtgtagaatctgtaaccgtttgaacgtcgtcttggagcaggtaatatgttgtgctcttcatagtaacgaattgcggcaggacttactcctgtttttttggcaagttctcctctagtcatcaactccatcgttactccttttttattattttgtcttactatatgtacattataaaggttgaactatacttcaaggtcaaggcgaaacattcattttatgttaggggaaaaatgacgaagccacaggatcagagagatgaacaaagtcaacgtttttttctaatagattaaattgaaataccttgtttgtattttatttttcattgatcattctactgtttaacatttttaaggttgctgtaaggttcggattaatacaagttaaggttggggttgtacaatgggtttgtaaggaagtgagggatgagtcaaatggtcccctcttctaaatcaatcatagaggtgaaaaggtttgagagaaaataaaattttgtcttcattatgttacttcagtatcttttttgcaccgtttctgtttccgattatcgtttacttcttaggaaaggatgaagtgaagtatcatgcgaaaaagtcactatggacgcatgttattccttatttgattttcggtattgggattgccggttcaggtttacttggcatgaacgatatcagtcatgctggtccgttcttaattgcaacgtatgctgtgacattccttgtggcgatctacttcttcatttggaacattgtgaaaggcattaaagtgttttcagaataatagatgaaaaaacggttctgtgattgagcagaaccgtttctttgtatgtccgttcaagcgggtaattggatatcaatcgttgtgccttcccctatcatactttgtatcgtaatatctccgccgtgtttttggatgatatcttttgcaatcgccattccaagaccagagcctgcatgtgtccctcctgtattcgtccctcgatagtagcggtcaaacactttttctagctctgcctcttcaattcctttgccgctgtcttgaattgtgatgtgggtatgttctttttgttcaaggtgtacaatgattttcacatcagcatcattgtgaacaagggcatttaaaatgagattggtgaccgctcttcgtatgaggatcgtatcaatattcagcataagcttgtctacattcgtttgcagctcaatggtttgatctgcatatctagaatcgttgaggatatcaattaacgtttcacgcagcaatggcacaatgttcaccagttctttatgcagcatcacatcgttatttttcagccttgttgttaaatttagatcctccatgacatctttgatgtacagtgatttattctctatgatgctggcataatgtttgatgtcttgatctgaaagaggataattcggatctttcatgatttctgcatagccttgaatagaggataatggtgttttaatatcatgagaaatatgactgatccactcttcccgcatttgctctaatttgtctttttctttttgacttgaagcgagctgctctgataagtgattgacattatagaaaacatctttatatatccccttagttggcagcttcgtcgtataatctccgtttgcgagccgctggatgccataaatggcacggccgagcggtttgatgagctgacggctgaataagtatccaatgaataaggcaatgatggcatcaatcgataataaaatcatcgtcccgatattgaattgcgctattaagtctttcgtatcaaaagaaaataaatattttccgatggaagggtccttaaatccgataaagtagctgtattccttgccctttccatttttccccccagcatagatcgtcgacatcaattgcttatctttatatttgtgtaagtttacgatttctataggtgtgtatttgctttttaagcctttaggtgcttgtgcatgataaacatcttgtccattttcgtctaatatctgaatccatgcattttgttgttttaaggcttgctgtccttctttactcacagtgatatcttgatcggacaaggtgatgtattgttcaaatgttcttgtgaaggtttcgggcgtattttcttcgttttgctggctacttgcttgtagtacaagccaaatcatgaatccaaataagttaataaagaccgtgataatggtcacgataatgacagagaccatatatctgcctgttaatcgccatttcatctttatgcatcctttacaacaaatttatagccaagtcctttaaccgtcacgagaaattctggtgtagatggggaattttctattttctctcgaagtcttcgtatatgaaccatcaccgtattatcagaaccgaagaaatcctctccccaaaccgtttgataaagcgtttctttactgatcacgcgattcgggtgctgcaaaaaataggtcatcaacataagttctttcggagtgagctcaatcgccgctccgtttttcgtcagttccgcttgctgctcgtttaactcaaatggcccttttttgatgatgggatctggttgagaaggctgtaagtatgacgaccgtctaagctgggcttttacccgataggcgacttcttttggactgaacggctttgtaatataatcatcaccgccaatggcaagtcctacaattttgtctgattcctctccctttgctgataaaaagataatcggaacatgcgagacgtctctgatttgtttgcaaatatcgtagccttcaccatctggcagcataatatccagtatgacgagatcgggttgttcttgatggaattgcgagagcccatcacgggcagttgaagctgttatcacccgatcaatgccttctcttgttaatacggtatggattaattctaagatttctttttcgtcatctataatcaagactttgctttgaagttttggcattatgatcactctcctgaagtcattgttattattatacccaaagtggagacgtcgtgaaaaatcaactttctatttacacagaaaaaagccaattttcttttttaatgagaaaattggcttttgttgttttttagcgtttgaccacaaatgttgtcacactttgagctgggagatgtgcccaaaattgatttcctgatatgtttaagtcagttccaggctgaaggttactgttgctgctcgtgatccatcttgacgcttgtgaagcagttccgttttgaataacaaagtgttgattgactcctgcattgtttttgttaatcgcgacaatgacgacctgattgtttcctttataggctgagacgaaaacattcggttcagggcttttcgttgcatcaattctgacgaaccctggacgcacaaacttggagaaatgcgccatgttgtatccacgcttgctaatcattccatcttctttcataggaccgtatgatctccggatgtaccaccatacatacgcttgaaagtccccttccaccattgaatggtgaatatgctctgatacccctaatgcctctggccagcggtccgctgaattgttatcactattcgggtagtagacctctgtcatccacagctcttttccccctcctttttgtttgaaaagaggatacggaagctggctgatttgggttccgtacaaatgggcaccgagaatgtccatattactaagcgcctgcggatcgtttaagataggatctgagatatttttaaggtattgaaaagattctggtgcaatcacacgtgcattaatggagccagcattttctctcatgaatcgcaggatttcctgaggtgtccaccatgtccattcatgtgcataatcaggctcgttctgtacagaaatggcatagagattgacgccgttatttttcatgaatgtcacaaaatcattcaaatgctgagcatatgcggcgtattgattgtatctcagccgctttgcagacgcaccattacggttgaaagtctctaccatatggcttggaggattccaaggcgaagcgatcaccaaagcgccgtgctctatcgctcttttggcggtggcgacttctctctgccaattatttctgttctcgtctacataaatccgtaaaatggagaatcctaactgattctgtccattgccaaaggcggaatccctttgagggccggtcaaatcaccaatccaagccgggtggttcattccgccaaagccgcggatcacttgtctttccgcattgacattaatattcgcatctgccgctgacacctcagttaccccaggccctaaaaacatgacagacaacatagtgaagcagaccaataaagtgcaaattggttttttgattatggacatcaaattttcccactctcccatcaaccagttttgtttacctttgagtaaactgccaggaatcaaattggaataggctggaaccatttcctttgaagacaaagaatacgttgtgtactcccgttgccccgttgactgctgtttctatttctcgccagtttccacctgtggaagggacattgagtgttccggcaattctgccgtctggactgccaagacgtacctcaatttgtccgcctgaagcggctgctacattggctttaaaggttctggcacccatcgatccgaaatcgacattactgacggccacccaatcgccgttttgaatgtttgtgacatgctggttattgactggcccaccaggtgctgaggaggcctctgttaaaatgcgtccattccaagcgaacgtttcggcttctacccgctgataaggatttaggttggaaagctgtttaacgccttcaaaattggctgcgacctctcgaagggagccgtcagcattatgcacaagcttattaatgtgtggagatctgtagcctttccctgctccgtataaggcagagctcaccgtttgtgtgtgatacacgacataccactcgtttttaaaattaaacacagcatgatggttgttaccgccgccaccgaaaaatgaacccggatttttcaagaagtgtcctttatacgtaaagggacccataggacttgagctcgtcatataaccaatctcgcctggtggtttatctgctgggtgggagccgccaaaattgatgcaataggaatagtaataggtaccgttatacttatgcattcccgaatcttcaaacataaaaggggcatcaatggttgatgcactgccgaccacacttgtcatgtcaggccctagcttcagaactcttgctgttttaggattggcccattgtccctgcgttggatttgaaccgcctggaacgcctcctccggcatataaataaccggtcccgtcatcatctacaaatacggctggatcaaacagccatacaacaccggacatccctggtgtatttggcgtgacgagcgcttttccgataggatctttccaaggaccaatcgggctgtccgctgtcaagacgccaatccctccgccgctgttagcaaaatagaggaaaaatttatccttcccgttgatcttcttcaccgcagcggctggagcccaagaagcgcctgcccatttggcaatccctttcccgccattcgccccattggcacctgctactggaatcgctccgtgatctgtccagttcaccatatccgcggaagagatgacaaaaaccctattcaaatttgcaaaagaattgtccttaatcgttccattgctgtgatactcatagtcatcgctcgacatataaatgtacactcttccgttataggtgagcgcaaacggatccgcccccaggtgatggtctatgagcggatttgcatttcctactcgttttgcaatgggggtacttgctgcactcgcatcatatacaggtacacagcttagtaccaaagcaaaaatcaataaacctaaaccgcacttcatcctctttctcatcgtgtcattttcctcctgttttcaacttcctaatattggggtttacgcccaatttcaaattatgttgatagacgctgatgaagaatgaatacaaaggatgatttcttgggcgaatcgctgctaaaacaacgatgaaaacccttactttttgactaggagacaacaaaaaaatgcagttctccttttagaactgcatttttttagcttattcatgattgttgatcacatataacgcgcggtcaccattttctttcttgtgtaaaactctactccgtctgttccattggcgtgcaagtccccgtagaaagaatccttccagccggaaaacgggaaaaatgccattggtgcgggaacaccgatattgacgccgagcatccctgcttcgatgttttcgcggaattctctgatgcttgatgcactgtctgtgtaaaggcaggcaccgtttgcaaattttgattgattggacaggtcgatcgcttctgtcagtgaagagacacgaacaattgataagactggggcgaaaatctcgtcctgccaaattttcatttgatttgtcacatggtcaaagatcgttggtccaacgaaatacccttttccatttgtttcatgatctttcctgccatctcgaatgagacttgcgccttcttcaatccctgactgaatgtattgaagcgttcgctccttatgtttctctcgaatgactggacctagaaagacctcttcatttattccgtttccaatgacgagctcgttcgattcatcaactaatttttgaatgagctcatctgccacttcttcttccacagcgacaacggccgcggccatgcagcgctctcctgctgatccaaaggcagcaccaatgatttgttttgttgccgcgtctaaatctgcatctttgaggacaatggagtgattttttgctcctgcaagtgcttggacacgtttgccatgctctgtgccttttttatagacgtattctgcgactggttgagagccgacaaatgaaatggctttaaccttttggtgttcaagcagaccattgacaacatcgtgagccccattgacaatgttgagaacaccttttggaagacctgcttcttcaaatagttcggctaaacgtgcggcaagaatcggcgtgcgctctgaaggttttaaaacaaacgtatttccgcaggcaatggcaagcggaaacatccagcaagggaccatcatcggaaagttaaatggtgtaatccccccgatgacgcctattggatagcggtacatgccagattcgagtccagatgcgatatctggtaattgttttcccatcattaaggttggtgcaccagcggcaaattcgacacattcaatccctcgctgcacttctccttttgcttctgttatgctttttccgttttcaagcgttacgagttcagccagctcatcccatttttcaacgagtaactgctgatatttaaataaaatgcgggcacggcggggaacgggagttttcgaccaagtggtaaatgcttcttgtgctgcctgtaccgcacgttcgacatctttttttgttgaaagcggcacttctgcgatgacctcgccagtagctgggttatatactgcctctgtttgactagtttctgcctcaatccattgtccaccaatataatttttcaacatttgtacatctgttttggtcatgttccctctctcctttttatgaaaaaatgtcatgcttataggatgtgtttggttgtcattgtctcatcaaatgggcgcccatcagtatacactctttgtcaaatattattgtcgttttggtttacgttgtgataaaagcttgctctaacgtgtgaaaggttgccgcccatccctttggttgtgagaaatgattctcgaatgcgattcattcatggtgattttttggttaactcttgattaaatttacaaaaatcataatattaaaaacgctttcagtcaatcctctttttgcagcataaaaaaacctgatgcgcgttgcatcaggtagaggctggtttatttctgttaattggttgatgcggtatattgattcggttctgaaaaatgcgggagcatctcaccatgtgcttcaatgagttcatcgcataatttgatgatgtcatcaatcgatagttcagcgcttgtgtgtggatcaagtaatgccgcttgataaatgtgctcttttttgccgctgattgctgcttcaattgtcatgagctgtgagctgatattggtccggttgagtccagccaattgttcagggatttctccgacatagcatggcatgatgccgctccgatctgcaacacacggcacttcgacacacgctttttcaggcaggttgtgaatgaggccgcctgtgttcagcacattcccagcaaatttaaagggaacgttcgtttcaatcgcttcaatgatacgagaaccatattcttttgagcgagtatgtgtgatcagtgtattgcccacaaggtcatgcttcatggtattccagttgttaatttgctcctcgcagcgtctcgggtattcatcaagtggaatattaaattgaccgatcaattctggatagcgcgatttgataaaataagggtggtattcggcgttgtgctctgaggactcagtgacatagtagccgaatttatccatcagctcaaaacgtaccatatcatgatgccgtaatttctgcttttctttcgctcttcttttgatgtctgggtacaaatcttttccgtcccttttcacttctaataaccacgccatatgattgatgccggcaattttttcttcaatgccttcatgatccatttcaagtgattcaaatagatcctttgtacacacctgcacgctatgacaaagacccaccgtttgaacctgtgtataacgcagcatcgcacctgtcagtgtggccattggatttgtgtaatttaacaataaagcatttgggcaaacctcttccatctcctttgcaaaatcaagcatcacaggaattgttcgaaggaagcggaagatgccgccgatgccaaccgtatctgcaatcgtttgtcttaatccatatttttttggaatctcaaaatcaatcaccgtgcttggccggtagcctccaacctggatggcattgattacatattttgcatccattaaggcttcctttcggttgtgataggacttaatggtcacatgtgcaccgtagttctcttttaaatagcggagcatcgtttctgattctttcagccgcttatggtcgatatcatataaagcgaattcaaaaccgcttagtgcagggacgaacaaacaatctcctaatatatttttagcaaatacggtactccctgcaccgataaatgtaattttagacatagacgactctccttttaacatcaaatatgtggaactaccctttgacagagccttgtgaaagccctgcgataaaatatttttgcaacagtaaaaacatcgtcaccattggcagcatcgcaatgagcgcagcggcaccaacgagctggagctgatgttgattttgaccaaaaaaatgggatagggcgactgtgagtgtatgcatctctttatcttgcaaaaagaagatggcaaattgatagtcgttccaaatatacacacaggcaatgattaaaacagaagcggtaataggtttcagaagcggaaaaacgacggtgaaaaaaactctaaatgtccccgctccatcaatacgggctgcttcttcaagctcctttggaatggtcgaccggataaagcctgcgtataagaaaatggttagcggtaaaaaagcagcgacattatttaaaatagcgatttgataggtgttcatcatcccgatctgaacgaccattttatagagcgggacaagggctgtgagtggtggaatgaccataatggcgatgaataaaacataaactgctttattcagttttgtgtttcttcttgcgagcggataggctgcaagagaaccaagaaagataaggcatacagcagagctgaacgtaatgatcacggtattcaaaaaggattggccaagctgagcctctgtccatgccgtgcgaaagttttcaagatgaagcacttttggaaacagccattttgaactgaaatctcctatcccctttaatgatgtcgtcaccaagatataaaatggaatgagatgaagcaatgtcaccaaaagggcgaggaaggagtaccatctcttcttacgtttaaaagcattttccatcacacctcggtctcctttcgtttgaaatacatcagtgctgcgacactaatgacaaggatgatgaccgccatgaagaccccttgcgttgctgcatagcctgcatcctgacgtttgaaatacagatcatacataaaggtcgacattgattgtgaggaatctcccggtccgccgccagtaagcgccacaatgacatcaaagagcttgagcccgccaatgacattcagcacaacattaatggtaatagacggtataaggagtggcaatgtgattcgcctgaattgctggaggctggatgcgccgtctaattgtgcggcttcataataatccttaggaatgctttgcagtcctgctaaataaatgatcatcgcaatcccgacgaattgataggtgttgacgagcacaatgatccatgtgtttaattgcggattgccgagtgcattcatttgatcaaatccaaaaagcgccaccacatcgtttaaggcaccgccttggtaagcaaacacaaaataccaaatatagcccatcgcaatcggactaatcatgacaggtaaatagacaactgttcttgtgatcgctctcatctttaagctttgatttaataaaagagcatatccaagtccaatgatattttgtaagatggtgctcccgattccgtatagaagcgtatttttaacaacaagccatgtcgctgggtcctgaagcagacgtttatattgatcaagcccaatccattcataagtttgtgaaaacccattccaattcgtaaaagatagctgaatgccgttcaaaaaaggataaatgataaaggtactgacaacgagaacagcaggcaagtacatccaacaaagggatgaattttggctttttttcattttctgctttggtaaagaggtgaatgcggctggctgctgagtttttgtgatgtcattcattggcttcactcctgtttcagcatgcgcctgctattgttttttcagacgcttatattcctcttccatcttcttcgataattgttctggtgtgatggagcctgctaataattcttgacccgatgttgccatgactgcccacatgccgcttggtaagtattttcgatcgaaatacggttcaatcttcacctcttcgtattgatcgtaaaacgtagaataatagttttttgcttttacttgctttaaggctgcttcggatgaggtgccttctgcgatttttttcgcattttcaggctttgcgagaaaatcaatgaattgttttgcttcttttaaatgtttggagtctttccatgcagcgaccgtaaaccgttctcctccaatccagctttgtttatctccttcatgaatagatggaactggcatcgtgcctactttgatcgatggattgagttcagatgcttcaggtcctaaagagcctccgacaaaggtgaaggctattttgttttgtgacatcagttcaggtgcttgagatagttttgctgtgaggacatctttgtttaaaagatcttgatctttcaagtcctttatgaactgtgcaagcggtgtatagagagaccaatcaaatgatccgttctcaagttcttttccgtagcgatggtttggaccggtgatcaacaaaggtgtggcgagttcatcaaagacttgggcgatatttgagttgtctcctcctggtatccaaagcggcacaacctctcctttgctcttttccttcactgtcagcaaagccgattggaattcatcaagtgttctaggtacctcaatgtcatagtcctttaatagattggcattaaagctaagcccgtcttttgcttgattcagcggatatgcgtatactttgccatcttgatcctttaaaatctgatcgagtgaaggatcaagttgtttcacccaattcatctcttttagatcagcgacatactcgctatagcgaagtttggcccagccgtgtgtgtcaaacagatccggcatatcgtttgcccccatttttacacgaatcgtatcttcatagctgttgcctgggaagttggcatcgattcgaagatgtggatgctctttttcaaactcacgaatcacttcttcaaacgcttttctttccccgctgttgctcatcgtcgaaaagagagtcaaggtgacctttccgtttgcttcagacgtaccgttattgctgcaagcagacaaaaaaatggtcaagacaaaggccgcagtgagcagcatgatttttttattcatggtttcctccttttgatcactgaaaattcagacgataatcggtagaattcatgcagttgcggaaacaaaagaagtccattatactggaattctattcttttcaaagagataagagagcataccggtaggctgccttgttcttcgcatgatctagccatcatgcgaagcagcttgctttctgcttttttgtctcttttttgtttgctgaaatctcgggttcaccccctttcatggatgaggcatgtgctgcctctttcgatgagtttggttggcacgacgacttttagaggaagctttctgccgtttattctctcaagcaaaagcttcaaaccgacttcccccatttcttctgtatatactttgacggttgtaagtggcgggcttgaaaatgaagctgcttcaatgtcattaaacccaacaatggatacatctaaaggaacacgcagaccggcttcgttgagcgcgcgcattgcaccgatcgccattgaatcacttccgataaaaaaggcttgtggcaggtttccttttgttatggcttgtttcatgagcatatagccttcttgcatggagtattccccaatatggatgtcatccagatgaagaccacctgcttcttgcattctcttcataaacgtcgtttgtctttcgtcctcaatcacagcattcccttcgaaataatgttcacgctcctttccgccaatatagcctagatgtgtatagccaatcgattgcaaatggcgaattgctcgatctgccgctctgacaaaatcaacatgtacacaatcatacaaatcctcatccgcataatgattgataaaaacaatgtgttccattcgattagtcattttttcaaccgtatcaggactgattcgtccaatgacgatcaaaccgtcaatatcttttagcatcgcacctttatccatgcttctcaggcgaaaggtatggagggtggacagcccttgtttggcatattctttttcaattccttttcgaatcgatgaaaaaaagggatcatttaattcttcgtcaatggattgagcgactacgataccgatgactggggattcagatgggcttttttcctctgcttgatcggcttttcttgctctcacgggggtatagtttaacttctttgcaatgtcgaggatgttttgtcttgttgcgtgagaaacggcaagggtttgatcgccatttaacacacgggatacagtagaaacggacacttttgcatcatgagcaatatctttgagtgtggtcataggcaaactcctcttggtttttgactaaatatttactaaagataattgaaggataccacgttggtaaagcgctttcaagtgtggatttgtgatttttaattttatttttgagcatgttttggttggatgcaaaagtttagtaaaattgcgtaaaaaaagaggattgtttcatcctcttttactcacgtgattcaattgaggctgtttcttttgaaaacaattgcttcattgtctcccaagccgtgtcgagttgctggtgaaggccgaataaacctgagtttccgataatatagatctcgtttcccgcctcagcaagctgccggaacgtgtgctcattacaagagccgtctacttcaattgaaaatgagtatcctctcttctcttttacctctttcacctgtttaattttctgaagcatctctttaataaaaggctgacctgcaaaacctggatcaatcgtcatgatcgtcactcggtctattaaatgtagataggaatctaatgcttcaattggtgtggccggatttaagacaaatccgacctcacagtctctttgatggatatgccgaatgatcctaaaaacgtctctttgcacgacctctgggtgtaagcagatcatgcttgcccctgcatcaatgcaggcatcgattaaaaattcttggggggattctgccataagatgcacatcaatgggtcgatctgttagttttcgaagctgttctatgaaaaagggtgataaggtgatatttttcacgtaatgaccatccatgacatcgacatgatatcgatctgcccttgtgttgagaatatgaatatgttcgcggaagtgcgttaaatccatacacatcagtgaaggtgaaaaaatggctgtcattctcagaagcctcctttttacagttgaaataaaagcttgatcaatccaattaagattccgatgataccaaagtctgtatctccaaaagttgtcccttcaaaaccaagggttcctaacacaggtaataaacaagcgggtaaaaaggaaagaagcaatccattcacaaaggccccagcgacagcccctctcacgcctccagttgcattaccatacactcctgctgtagcgccgcaaaaaaagtgcgggacaagaccaggaacgatgacagttaaaccaaacaaaggtaaaagaaaaatagatacaatgcctcctgcaaaactgcataaaaaaccgataatgactgcatttggagcaaatggaaaaacggttggtgcatcaagtgccggttttgcccctttcacaaaacgatcggcaattcctttgaaagcaggcacaatttcaccgattgccatccgtaccccggctaaaataatgtacacaccagcagcaaaggttatcgcctgaatgagaataaagacagcgaagttcgtgcccccactcatttgttctataaagggaatcccagcaaacggtgcaatcgcaaagaacagcaaagccatcgtgattgaaatggccacagatgtatctcgtagaaagccgagtgatttaggcacttgaatggtttctgttgatctctctggacgaccgatccattttccgatcattcccgctgtaaaataaccgaaggtactgaagtgtccaagcgcaagatcatcgcttccagtgactttccttgtgaatggctgaagaatagcgggtgcaatgaccatagcggttcctaatataatcgaaccggtggtgacaagaaacgctcctttcattccacctgtcgagagaacgactgcgagcattgcagccatatacaaggtatggtgtcctgttaaaaaaacgtatttaaagggcgtgaattttgccaataacaaattgaccagcatgccaaaaatcataatgagagctgtctgtgttccgaattccttttgagcaatggctgccatggcatctgtatttggcacaactccttgaatgtgaaatgctgcttcaaacatttttcggaaaacgccaagtgaatcagacacgaccgtggcgcctgctcctaatattacaaaacccatggttgtttttaatgtgcctgacacggtatctgcggctgattttttctgcaaaagtaaaccggccagcgcaaacaaaccgatgagaattgccggtgtacccaatatatcgttcatgatcagttccatcatgatgtgaatcccccctttttcgtggcttatatgtgtttgcgaaggacgtctttaatggcttcctggtctaacaagttatttaatccagcgacctttcttgtgccgtcatccagctgatcgataatgtctgttgctccgatatatagatcagcttgttcatttttacttgtgctgagatcagtatggtccacttcagctgcaagtcctaactcttccaatgcttttttgacattcatttccacgatgaagctgcttcctaatccgtttccgcatacaacaagaatttttttcattctctatttactcctttatcgttgtgaaaattgatcaattagtttttgcaccgatgctaattcctttgcttcaaccagttctttccttcgcttttcatcacttaacagcatagtcagctgtttgagtgcttttaggtgggtcatactgtcaatggctgctagcacgatgatgagacgaacctgttttttttcatccttagagaaaaaaacgggccgttcgaaagacatgagtgacatgcttaattcgttcacgccgtcctctggtctggcatgtggaatggctacttgtggtgcaatcacaatataaggtccattttggtcaacggactgaatcatggcatccacataacctttctgaatggcattttgatcgagtaaaggctgcgctgcttttgtgatggcctcttgccatgtttctgctgtttgttggagatgaatggttttttctgttaataaatcgtttaacactggtttccaccctttctgatgggatacatatgcgggatgaagcaactttttaagatcacgaagcagtgctttttcattttttacgatggtatgctcttgaatgatgttgaataaagcgttcacattgttcttatcaaacatggtttcggcactttctccatattgaagcaaggtttttttctcataggcagtaaggatgggatgaacgagatgaactggctttcctttaaacgaaataggtgttgttgacacaacaaagtcgacatcaatcgatgacagttgttcatatgagcgctttgataatagatcacgtacttcgatataaccgattaattcgataagctgtgttttcagcatgtgacttgtgccaattccttcgccgcaaacaatgtatacagaacgccgcacaattggcgaaatcccttctcttctcatccaaccaccaaaatgcatcgccacgtaagcaatttcatgatcacttatcttggagcaggtcgccttttctaaatgacatacgaccttttgagtgatatcaaacacctctggctgtgtttttttaatagattctgttaattcattgttgatatcaatgtgatagatgagtctgtaataggcagggatgagatgcatggttaagttttgctccaaggcttcgtactcttgaaaggagatacatgcataccgctgaaaatcaaaaatcatttgtctggcaatggtgcgaatgagatgctcttctggcttttgacttgatggaagcttttgtttcttggcgctgagccatagagtgctaagaaaatagatttcatcatcatgaacttgaagacccgtttctttttgaattcgtgccatgaaacgaatagccgccaagcattcctcagtttcctgcaatgtacgcttttcttcgtttgaaaggtgtatagcacgtcctagcttcatccgcttaaagtagaaaaagagatccaaagacagctgatccagcatgtcatcagcaaactcgagctgaagctcttgttctgactgctcgaggagatattttaacctgttatatgaaataggcccctttaaccaaaaagaaggaaatgctttttcgttttttatcatggtgcgaatggaatgaatataaggtttcagtgccaatcgaatcgctctttcttctcctgaaatcaaatagccgaaggctgcctgatagtgaagcgtgagctgctgctttgaaagtgcttcttttagctgtttcatatcttcaagcaatgtattccggctcactttggtgagcttcataaaatcatcaatttttagacatttctcactgcatgcaatggataagagcagaatagcccttctttccactaaacatggttcataatcatctccaacgagaatgctgttcgctttttgaataatgacttctttttcatgtgggtgtaagtagtagccaagttgatcttttcgctgaacgtcactaagctgatggatttccagccagctattcatgcgtttgatttcagagtagacggttcgagtagagacattcagtcgattctgtaaatcttcaattgataaataagatgtcgtgtgaatcagcattgatagtaaagtcgtgcctcttttggttaagtgcagttggaattcctcccttcttctctttggttataagtctaatcaactcacatgcgtcaaagaagtccaaatgttttcagtaaatgctgtgcaggtttttgggtgctcttttgttataagaaaaagcacactcgtatgagtgtgctttgagacttgtataaaaagaaccctttttctgcttttatatgatagaaaacgattgtcatgaggtcatggatgtactgggaattttgaatgaccttttaagatttaaaaataagaaatacccaatattgccttgctatgtgatcagcttccgaatgccccattgagcaatttcaaccgcctcttgactcaatagattgtcgatagcggctctggcatttttcaattcagttaagttagcagctgaaaactttcggtcagcttttgcaacttcttcaggtggatcagtttggatccccgctaagtcatcagtaagcaaaatctcttgtgtaatttccacaaagtcttgcagtgctgcccttaccttttcaggatcagtctccaagtctccatcgtcgtaagaatcccatttaaataaaacagaattcaaggcatcttgtgccgcccaaaactcacgacgcatgcggcctttgtcatatctgttctttacttctccttttgataaaaagaagtttttgagcaaagaaaaaagccccttctcatcagaagctggcttgtgatcctcttgttttcctatgtctgctgttccggccattgaatatccggtgatctcacccttttgaatctgttcccaaatttcatcggaagccttcgtcacaaggacccacgatcctttcttgataatctcctcgcccatttcaaagtcagccggtgcaatgtacgattcaacgacttccccgacaccgccttggaaatcatgctgcttgtcgatctcacgtgcatccttcaggaacccatgagcggctttttcgatttcttctggtgtcatgtaatccccatgtgcatccgcaacgtttggttcataaacaataccgtacacaagacgctgcgcatcatcagctttcgcaatgaccttgatctctttttgaaagtctggctgcttttccgatttcataaaaaagaactgcttttgattagcagccttgtctacatatgaaacgtgtgtgatttttgcgttaatcaattcgcgtggcaattcattcacctcctttcagaggatttctaaatgcatagtaaatatttcgctagcatctaggaacctattagcttgagattcagatatttcgtcataaccagataatattccaaacaattcttgcagattaataaatgagtctctcaatttcaaatcaataatattgttttcatagagcacatcaattaaatctcttgcatcatgataagacaattcaatatcgtttttatcacatatttcaactatcttcttgtgatataacgccatgctaacaccacaggaaaccgaggaccttttatggcaatttctctcttattgctttaaaatcatttctcagtggttctaaattaaccatttccacatcaatgttattaggtatcgcattagaagtaacctcattcagttttttatcaatcaattcaagttcaaaatctttgtattttatctttgctatgtttttaataagatcagtaataggtgttttcagcataatcactacaataataatcgagataggccatatcattgctgtaaaaatagttataaacccattaaacatagaagatattaattcataaacattcataatttcccctcattctcaaagtaatgaggatattatactattttattccatgttctgtaatactcttcttctaatctcttctttttcctcagctgacaacccaagaataacaggctcaaccacaggaccaaccgcacaatgacaatttactcgctcttttggcgtgagctgtgtatctcttggaaacatgcaccgctctccgctgcccggtatctgaaattcctcatcgagtggaatgatcgtgccgtcaagctgcacatgacattctctggactgattctttttcccgccgcagtgcttccattgctttgccgttacagctggagattgtacatatgattcatgttgagcgacggaagaagcggtcaacacttctgtgatagctatcacacgtgcgcgcttccggctgaattcaggaaggtctttcagctccagttcaatctcctggatagagcggccttcttttataccctctttcaatgtttgctcaatggctgtatgagtattcagctgatcgtctttagatataaaacctccattaacaccaaaaaccttgaaaggtattaagccattcaaggtttttttgtataatctcattaaaaatcaactaatttgaattcatttttgaaaggaaatcttgaagaactaactttactggtgaattcgcagtagtagtcaacacttgatttgcacgttctaaaatttgaggatgctccaatatcaattttttgccttcctcaattggaaaacttctcaatgtatcaatacagatctcaaatagttctttatcattaatattcaacaaatccattaaaatatttaactcatattcattgcactcattatctagacagtacgcaattttccgctgccactctattggcttattgcgtacctgatttgataattcttcccaatcgttcaagctaaaatccgagagaatctcactagcaatcaaacacccgtcgtcataccacgaatctaccgttgtatcagcagataaaagattatctaattccttaaacacatcaatacctccatttaaattaaaatcctgatgggcgtaaagcattttctgtacctgtcggatacccgctagttacatctttccccactttaatcacatcaatttctacaccatcaatacgtgctctatgccaagttgctctatctcttaatcttgatgaaatagctgctgtatctccaacgtcggtaatacttttgagaattttctcatccttccaagaatcaggaaagagcgtgctttttttaatcttagagatatttccatcagaaaactgttttgtaaatacaacattttttgtaccatccacatttgttgataatacttcaactgcaaatttttcattatcattattaattctaggcgaatggccacctattaactgatttttgggaaccttccgttgtccttctagaatcttagcttcaatttctggactaattacagttcttctagcagaatctccacctgcaccctgaattcccatctttccatgaaaccctttcgctccaaacggcaaaagcattccaagcgccgcattcatactcgcctcctgctgttctttcgagatcttattcccgaacatatctctaccagtaattgcttcgctgaagccattggtggcggtgaggccatataagcctttttgagatgtttttaaggcgtcaaaggatttttgcgatgtcttgtagatgtcgactgctcgtactgcggctgaagtggcttgagagatcaccgaaattagaaacaccttgtagtgctttttttaaatctaccatttgttcgcggagttcctggtagtgttttgctcttgcgtccatagcacttgttagtgcttttgcatcaagtatcttgcccagaagaagtcactccctccattattgatcataaagtctattttacctttctcatcgaattggaaaaataggctttaagttacaaaaataattttcggatattttaatagagatgaaggcaagtgacaattgaaatgattttcctaatcatcacaaaaaaagtcagccttcttttcagaagaccgactaccttttgtttagaaaaagcgtttgaggcttttcttgagtggagggatatccagctcacctttttcaaagaattttttcaataaatatttactgaagcctgctgcttgggtgtaagtaattttcccaggtaacggaggttcattgtctacagcgacatcaataatgactggcttatcggattgaagggctgtatcaaaggctggggctaattcttcatgtgatgacacggagattcctttgccgccacatgcctctgcaaacttagcaaaatcaatatcctccagctctataccataattcatgtttccttttacctgttgttcatattcaatcattcctagattgttgttgtttaaaatcacgacaacgatcgggagcttatattttacagctgtcacaaagtcttgcatgaccattgtgaagcctccatcaccacatacggcaatggcttgtcgattcggttcattcaatttagctgaaattgcaccaggtaaaccgcatcccattgtggcaagccagctggagataatgaaatcctgctgtttcatttcaaaatgacgtgccatccataccgtcacattacctacatcaactgaaagaatagcgtcggcctcgactgcttcttctagtctagcaatgacttgctgtggtttaatcggtgaagtagcaacagatttttctttatccatttcttctcgccacttcatcatatgctctgtacaagcttcaagaaaaccacgctgctctttatattcaatgtaggaagtcagttcatgcaaaccactcttgctgtcgctcacgattcccacatctactggatatcttttaccgatttgatctggtttaatatccagttgaatggctggcgtgtcttctggtaagtagtctctatatggaaaggaggtaccaagcataattaagagatcacattcttccatcgcttcatatgccggcttcgttccaatttgacctagattacctagaaagtatggatgcctgtctggcacaaccccttttgcagggagtgtgatgacgataggagccgctgccttttctgcaaatgaaagaagctcttcttttgcatgtcttaatcctttacctgctaagatgaccggcttcttcgcattattaattagctgagctgcttttagcagttgatctttcttcggccgtacttctccctccacataaagaggggatgtataaacaggtttacgctttattttttgagaaaataagtcatccgatacggtgagaactgccacacctttatgggtataagctgctttgatggcttgattcaataagtcaggcagcgcctctgctgtctgtacctgctgattaaaaacagcgacatcgtcaaacatccgctccaatttgatttcttggaatgtatctctgcctacttcggctgaagcaacctgccctgcaattgctaaaactggtgcaccatctgcttttgcatcatacagtccatttaataagtggacagcacccggtccagcgatagataagcagacaccgagtttacctgttagtttcgcatcagctgccgctgaaagtgctgccacttcttcatgtctcgtttggataaattttatttggcttgattcatgcctaagttcttcaatcaattcgtttatgctgtcaccgggcattccataaatatgtttcacgccccactcttccagtagtgctgttacttcttttcctgcggttctttgcggcatgtgagaaaactccttttttcttactccataccaccgcatccttttgatcaaacgtttcaacttgctcctgctactttttaaaatgataaggcagggttgccaccacaatatcccgcttccataataggcggaatcttaataaaaaggcagattgattatgcaaaatggtgtgccatctttttttcggaataaattgaggcacaagcaccatcactttatattgatgcgcatttgcttttgcctcaatcgtttcaagaaatttatcaagcgggtgaatgaggcttcggtaagacgagtgcaacatcacaagtcgtacaccgctatttagtttttcccaatcctcttcaattttcttatccttttctttatcaaaggatacatgaaccgctatgacttgctctgacaaagactttgcatattgaacagattgttcgacaacacgcgtcacacccgctataggtacgatgaccacatttcctttaatctcaacaggctctgtttcattcattaaacgcaattgttccccaacagacaggtaatgctttttaatggaatggaagataaatagaacaataggcaggaaaacaaatactggccatacgagatggaacttggtcaaaatgagaatcatgaaaactgtaaaggaaatcagtgctccgacgatattgattggcattttcgttttccatccctgcggtttttcacgaatcaactttacacacatgccggtctgcgacagggtaaatggtataaacacaccgacagcatatagcgggataagatgttctgtttttccatcaaacaaccagatgagcagcatagaggctacgcctagaaagataatgccgttagagtaaccaagccggtctcctcttacagtaaacatacgcggcatatacttatcctttgctaaattcacagccaataacggaaaggctgaaaagccggtatttgccgctaatattaggattagcgctgtgactgcctgaatgacgtaatagaaaaacgttcgtccaaaagtgtctgatgcaatttgtgatacaaccgtttcttctggctttggcgaaatgccgaaaccaaacgcaagcaatgtgactcccacaaataaaacagctagtaatccacccatcatcaataatgttcttgctgcattttgagcagccggttttttaaaggatggaatggtatttgaaatggcttctactccagtcagagcagaacagccagatgaaaaagcttttaataaaagaaataatgtaatgccttgtacgtgtgtgcctactgctgtatgctcaggtgctggcggtacgccacctgttaataatttaaagccgcctactccaattaagataaggagtgaaaatacaaacaagtatacaggataagccagaatagatgccgattctgtcaacccacgaagattgagcaccataatcacaatgaccaacacaattgagatcaagacatgatatggatatagtgctggaaaagctgatgtgatggcatcagtaccagctgatatgctcaccgctacagtcaaaatatagtctacaagcaatgatccaccagcgatcaatcctggtttttcacctaggtttctgctagagacgacatatgccccgccgccttctggataagcataaatgatctggcggtaagatagaattaacgccattaaaagaattaatacacaacctgcaatcgggagtgagtaccaaaatgctgctgcactaacgacagaaagaacaattaagatttgttctgtaccatatgcaactgatgacaatgcgtctgatgacaataatgccaacgctttgatttttgatagtttttgttctcctgctgcctgtgattttaatggtttaccaattaaaatacgcttcatcaaactgtacatgtgatgcccgctcctttagtgtcaaacgatttaagttgcaaaagatggatcgccaaaaagacacagaggcaatagaatgcccctgtgcctattctttagatcacaggttggtctttgctctctttaacgcttacgaggttagctgacggattcgggcgcatgagactttgccctacctaaaaaggattcaccccacgtggtgcttcacaccacaattggttcccccgctcatcgaaatgattcagcgattggtcttttataaaagagatcatactcccgtttgacaccaaagtaaagagattttttcgaggtcttttgaccgtttattaatcagtctttttgcggttttttcgtacgaaataaacaatcatcacaacgacaaaaatgatcagtacagcgatacatgcaaaataaatccaagactcaccgccgccttgcttttcaccttttttcatatcattttttgcattgctgactgtttggttgttagagaacatatctttgttcttgctttctattgcaactgtagcggtctccgtatttgtttgaaggaatcgaatcacttcatttgatatatcagcgtcagctgccgtcattcctgaaaaaacggtcatggtttgttctttattccatacagatggctgcgtccatacaatacgagctgttgtttcgttgatcatgccaaatgaggatacatcatattgaccctttttcgctggaacgatgagatcgtctgctttttcttttaaaagagagaatgtgtggatgcccccgaagaaaatcagagagttctttttcaattgttcatctgtcacattcgatgcttcgaccaaatgatagtgagcagcttccggttgactaaatgattcggtcagcaatgccatttgattgattgatgcttgagtgatttgatctggcataatgatcaatgtgtttccttgctgcgtttccgaagtgtaagggagcggccatgcggctaagtcgggtgtatcagtagttgttccttctggtatttgaagagagctgttcttatcaatgtaaatccagccttcttcatccgtatgtctacaagattccatgtttttaaaacctgttgtgacaaactgtaagtccacatattcattcttttgaagtacttgtgaatctactggaatcgacacatgatagaatccattctcatctttgtttcctagttttgttaacggtacgtcgtacggttcgttattgatcatcactgttagacgttccgctttgttcgctggatctgattttttaaatgatagatttagttttgcacctgatttttgttgagccattaatgctttcggataatagtaatgatcagatgctgtctttttggttccaactctgacatcatctgcgccaaaatctattaaacgaatatgatgagatggcttagaagcactagctgtcaccttttgcagcagcaagtcggttccagtgagctgacctatcagttctggctgagtcaaaacattgattttttcagcaattgtctttggctgctcagcagtgacaaataaaatgggttgttcttttttctttgctgtcagggttctcaccgctaacgtcagttgatcgccttctgttttaattccagccgcttgctcgatcgatttcattcgtccattccagcttccttttgctcccacagcaatggttggatgtgcaatttgctcgacgtccttttcttgaacgagtttgaggtctgctaggcggtctttgtttttcaacgtacgatatactttcatggccgcttctaattcagccgcttctggtctatttggaatcacaatatctgtttgttcttcctgatcacttgatggaataaatggtgaaggaaagctgtctaacgtcacgtctttcgtttgaactcctttgaacgccagctcactttcaggatatactttcagccaattggcaggcgtctcttgattgatacacacaccttcttttaacacaccataaaatgcgagttgaatttgatgagatccttttttcaattgcgctttattcaatttgatttgtatcgatttttttgcgttttttcctgatacagggatcgttttttcaatctctccatcgatcatcactgtgaaagacgatggcgatatgagtaatggtgaagcctctatatttaatgtaagagtgctagactctactttttctttctccatttgataggaaaattcagtgcggtcttcttgaccatacaaggttaccacatcttctgatagatgctgcgtttctgtttgattcccttttgatgagtgaacccaatcgtctttcacttgtactcgattggattgcgccattgcttgacttgccatgaaaaaaggctgaatggcaagggatagcactaatataaaaaacatccatttgaccgatttcaatttgtcacccgcttttcttttgttgttgatcgtaacgctctgttttgtaccatttcacttcttgtttcaataatcggctcttcacctctacacataaggagtacacgacaagcgcaatccatacttgagaataagtgaagtacatgagaaccactatgagaatattttgtttagtgagctctgttttctcaatacttaatgtaatcatcacttctgttagaaagaggaagaaggctaatccccaaaggatcagtgcgacagcccctacagataagtgaaggtcaacaaataggtttacaataaagatgccatttgagagcagaacaccgaagaaaaataagaaatacgtaaagaagaaataaaacaaatcaaaaatcattcgttttcgtttcagcttcataaactgtcttaaaaatttaagaacaacatattgattccctctagcccagcgcgttctttgccgccaccagaccttccatgtctcaggctcttgctcccatgtgatcgcagctgggaaaaatcgaatcacatagccaaggttatacacacggatcgttaattcggtgtcctcggccaaagcttggacatcccacccgccgagctcttctaaaatgtgccggcggatggcgaagttggtacctggtattgtcgcaatcccaaaccatttccatctcccgccctgcgccatccattgaaaacagatggtctcaatattaataaatttggtcagcaaatttttggctgcattgatcaccctgaatttcccgacaacagcgcctgcttttgcgtcatttaataatccaagaaccaaatgatagacagcctttggttcaggcatgttatctgcatcgtatacgcaaatcacttctcctgttgaagccttcaagccttcattcagtgcagtggatttccctttccctgcaaatggcggcttcgtttcaatcatatgaacatgatcatattgctcactaaatgattgcacaatctctcctgtgcgatcagaggaattgtcattaatcacaatgatttcaaggaggtgtttaggataagatagctgaaccatcgcttttaatgtctgccgaatgacgacctcttcattatgagcaggaatcagaatactaactgtcggcagatccttcccttgtttcgtccatttaggcagcactttttcataggtcaggtaatgctgaaagccgccctgcataagaaacatgtggtataggagcatgatccaaataagcattaatgaaagataaaataagacatcagccacctaattttctctccttaaaaattcgttttttcattgtcagtcttaaatacaatgtgtataaagcaaatgccgcaataaacagcatgaccacgaccgtgagaattctcagcacattttccataccacttcgtttgacagtttttgtttcggcgatgttggattgctctacttgaatatgtccattcccggatgtttgaattttgacatgtgcagtttggaccgtctgttttgttttctttatatccagccaatcgctagaagggattgcctccatctgtgtgattacatcctgtaaccctgctatccccaactccacgtcataggacagccccattgcggctgattgcagatgctgcacggattgaatcgtctgttctgttaaaacatttgaacttttttggtcagacgcttgctcaaattgccgctgaggatataaggtcatgccgtgtaacatggcaggagacgtcacgagcggggatgcaccgactgatttccaagtgcggtctgacagctgcacctgtccaaatagactggacacatgctttgaaataacttcatacccttgttgagatatcgcatcatgcggcacctcgaacccaagaggatataagccttgactagcaagaagctcaatgccctttgtcagtttttcttctgtataggcgatttcttgctgctgatacgatttggtatacgtataaaagtctttttcatttgggaattggcttttactttgtttcttctcagcatttttgggttcatttgtcgtgatgggctgatcatattttgcatcccagaactcaaatccctgaccagattcctccgttcgatacgtacggctaaagccatgaagaataatactcgctccattttcttgcaattgttttaaaacactcacaagtttcgggcggtcactcagtgtgacttcatcacctgttgcccgatttatccaagcaggggtcactgcaatctgataaggaatatgctgtgcggatacgtattgtccaagttcaagcagctttttctcgtcacttgctggactgatgttcccgagcattaagtattttgtcgtcatttgcacagaagatggcatgtatttttctagcacttctgcaagaagctcgttgtgctgcacaacatctaagataccgatatatgccgcaccttcttttgtttgagtcacaaatggttgatcagattgacgtttcttcactagaaattcatttttcaagtctgcccctcgaaccgttaacacattgatacttctctctaactgacgatatgtctgatcatgtgtatgtttcacttgactgatatgatcttgtttctgaaaagtaagcttagagaatgggcgaagctgttccgcattgtatccaatggcgatgaattgctgtgattcgttcatcgcacgaatcgtttgttttgacaaggttctctttatttcaccaagataaatgatttgctgaaattcattaaccctcttttcagccaaatattcatcagatacaatcgtcgtctgttttgaaaaatgaccggcgagtagatccagcatatgaacggccggagtcacttcccccgatggtgtagaataaacgatcagtgtatttggctgcgtgacaagcgcatcggctgaagcaatgtgtttaaacgaaagaatcgaaaaaagcgtgatcatcaaacaacatttcatcaaagaattaaagttcattcatcatcatctctttttctagttcttctaaaaactgctctggcgaacgataatccgagctgcttgttaaatgacagacatgaaatgtcaagatcacttcacgaccatttaataggacatgtgtttgcagtttaacctttagcttttcaagaacaactgacacattttcttctggtgtatgagttagcagcaagcctattcgttcttcagatagccgaaatttcttatcggtttctcttacgctttcgcggatcttgagacttaattgctgaaataggtgctgcatttctttttctccatataacgatttgaattccgctgcgtaattcatatgaagaaggataaagacaaatggctgtttgtaccgttctgcccgtttcatttcctcggataattcgagcttcatccgctcagcattgtcaaatcctgttgtcgagtcaatcgccacaaattgtttgatggcctgcttttgttgttcaatggtgtgacgcagcgtattgatccgttcatgcaagcttcccgctgaaacagcgaaaaaaagaagtgctacgccccaaatcactacatcttgcaatgtttgatttgaaaaaagagcattttcatgaccaagctctgtaaagaacatggcgcttcctataaagaacaaaatcagcaaggtgaagattaatgctggtaggataccaaataaaataccgcagcctaacacgacaaatgtcagtgcgatgatcataaagctctccgcatcttgtacgttgaggtagcccataaacaaaataaggcctgcaaacgtgaggagcagagaatagtacaagcgatacgtgttactgaacaaccgattcatttaaaagctccctttctgcaattagaggcaataagttatcaaacgagtgagtctctttttcgttcatgtatcctccgtaataaggctttagaggatcttgggtttgtaattctttcatacggtgatagaccgtctttgcgaatttcagctcgttttgtttaagggcatacaaaatgacgagtgcatataccgaaggcgattcatatgtgacagatggctgcaatgtgctcagcttatatctcccgtacagttttccttcttgtttaaacgacgttttcagccatttcatgatcgcggacgtattcacctttgcatggtatgcatgtaaagctgtataaagttgatcgatcatattaatttcttgatcgaatgaataggtttttttctttatgtcataggacttaggaaagaatcctttttttctcggtgcttgttttagaatggctaattggttactggtcatttgtttcgtgaatatgtggagggattccaattctttgattgcttttgggtctatataagagagagtgattgtgtgcgaagttcgatttgttgatgcatcataataatcggacaatatgcctttgaacatgtttttttcttttaacgcttgagcgatttcttttgctgtcgtttgatacgctgactttttccacaaacgatttgccttttgaagtgccgtcactacacgtaaatcatcaactaaagcattagccttacttttttgttcagattcaatttgccagctgagaagacgatggtctagtaaaaattgatcttgtagaacatccaactgttggtcaaataaattttgatctttttttcgaacaagataatccatccaaagcccaagtgattcagataagtaaatatgctcctctgcaaaggaggtacgaatcaacccttgatctgtcattaagtggtgagtgataaaatattcaccaggtaaaacgggctgtggtgatactggatcagctgattctttctgctgcctccaggtacatccgcctagtagaatgacaatgactaaaacaattgctgtacgatatatgcgtgtatgcattcgtgtcccctttcaactcaccgttctctaaacatctaacgatttattatagagcgtttttgcttaaatttaaataaatattttataccaaattacgagtcttttcgcatattcattcccattttcagaaaaacagcatgtcaatatacttgataatactgaaaaacccatgcgtttctgcatgggtttttatagaactattgatctaattttaatttctttaattgttcagctagtgcgttattaattggttcttccactttcttttgtttcttcatatatttagacacatcgtgcttactggctttcttttgattggattgagatttgcgtttttcgaagacagacagcttttctctatggccgcatacacaagcaaagattttaccatcaccttctccgcgcagttcgagctttttatgacagttcgggcagcgtgcatttgttttctttgccacatttttacgatggccgcattctcggtcctgacagacgagcatcgtgccatgttttccattcactttcagcatgagtttaccgcagtctggacaatgggtgccagtgacattgtcatgcttaaaggtttggttcgtctgtttgatttcagatacggcttgtttggcatacgatttcatttcactcatgaattgagaagctttcaattgccctttggcgattttagaaagcttttgttcccattccgctgttaatgcaggtgactttaggtcttcaggcactaacgagagcagctgcttccctttcgaggtgataaaaatgtctttgccttttttctcgattaagaagctattgaacagcttttcaataatatccgctcttgttgctactgtccctagaccacctgtttcaccaagggttttcactaagtccttttcctcgttctgcataaatgccgctgggttttccatagcagataatagggtcgcttcattaaaacgtgcaggaggcttcgtttctcctcttgtttctttcagctgtcgtacgtctagtgactgtccttctgaaagcagcggcaaatgttgatctgcctcggctgattcctcttcttcatatgaatcatcgtacacggctttccaaccagcagcttgcacggttttcccttttgctgtgaacgtttcactgcctattttggtgatcaccgttgtttcctcatactcaaaaggattcatgagtacagcaaggaatcgtttggcaatgaggtcatataatttacgctctttatcgcttaatactcctgggtacagctcttcctcggttggaataatcgcatggtgatctgacactttggcatcattgacgaagcctttgtgcgctttcacacctgattgtaaaatccggttcacatgctgcgtgtacggtctgacgttcattccttttaaacgatcttttaatgtaggaacgatatccgctgaaataaatcgtgaatctgtacgtggatatgtgacaagcttatgctgctcatacaatcgctgaagcgtagataatgtttctttggctgagaagccatagcgtttatgtgcatcacgctgcaattcagtcagatcgtacagtcccggcgcgaaagcttttttcgctgtttttttcaacgcatcaaccactgctggttttccttcgcaggctgccaagcgctctttgatcacactctcttggaatgtccggttttgctttgttttggcatcctgccatgtcaaagtcagtccatctacttgtgcagtcaatccatagaacggctttggctgaaattgttgaatgtcttcttctcgtttggcgatcatggcgatcgttggtgtttgcacccgtccgcaggaaagctgtgcattgaacttcgttgtcagcgctcttgttgcgttgatgccgacaatccagtctgcctctgcacgtgcaacggctgagcgatacaagttatcgtattctttgccgtcttttaaacgtttgaagccttcttgaatggctttgtccgtgacagatgagatccatagtcgtttcaaaggctttttcacatgcgctttttcaagaatccatcgtgcaacaagctccccttcacgtccagcatctgttgcgatgacaatgtctttgacatcttttctcgcaagctgcgctttcactgcttggaattgttttcctgtctttttcatcaccacaagcttaagcggttcgggaatgatgggtaaatcctctaaacgccaggattgaaactcttttccgtagccttcaggatcagccagtgtgaccaaatggccaagcgcccatgtcacaatgtattgatctccttctaaaaagccatttccttttttatgacacttcagcacacgtgcaagatcacgtccaaccgaaggtttctctgctaatacaactgtttttgacactagatttcacatctctttcttctatccatccttttattatagcagacgtgaagatgcggttctaatgacggattatttcttcaatcgtttgatgatttcattcgtgacttcttgcgtttgataggcgccgccgatgtctgctgttaaaaagccatctgctgtgactgattcgatggtttcgagtagatgggtgcccagttcttcctctccgaaatgatccagcatcaatttagcggtccagatttgaccaatcgggttggcaattccttttccagcaatgtctggagctgagccgtgtacaggttcaaacatggatgggtatttgccatttacattgatgttggcggcaggcgctacgccaatacttcccataatggctgccccaaggtctgtcaaaatatcaccaaacaaattactggcaacaatcacatcgaatttttctggtcttgttacaaagaaggctgagagcgcgtcaatgtgctgtgagtctgctgtcacctctggataatcctttgctacgtcttgaaacacttcatcccaaaaaggcatggtatgaacgatcccattcgatttcgttgcactcgtcacatgctttcgccttttttctgctaattgaaaggcaaaacgcatcgcacgctctgtcccttttcttgagaacactgcattttgaacagcaagctgatcttctccttgataaatacggcctccaatttcactatattcaccttcaccgttttctctgacaactagaagatcgaaatcctttggctgagcaagcggtgagcgaatgccgctcagctgttttgcaggtctgacgtttatcacttgctcaaattcccgcctaatcttaataagcagtccccaaagtgatacgtgatccggcactaaattggcatctccgacagcccctaagaaaatgctgtcaaaggctttcaattgatgtaatccatcctttggcagcatctcgccatgctctaaataatattcacagctccacggaaaatcctgaaaggtaaaagacagaccgccatgtacttctgataccgctttcagaactcgtatcgcttcaggtacaacttccttcccaaccccgtcacctggtatcgccgcaattgaaacatgcttcattcatttctccccctttattgtcggtcgaccgtcgaccgtttaaatttgagtttactagagagtacaagttctttcaatggataaaggcgcttttttaatcaaagcgcctgtttatcctgcaaaagcaacgagggtttctccttcttccccctcgcaccttttttatctgaaagcagcagtccgcctaaggtcagtgccgttccgagtgctgacatgagggtcaatctctcatgaagaacgatcattgaaataaccatcgtaataataggaacgccataaatatacacactcgctttcaccacaccgagcgttttcactgaaaagctccatgtgagaaaacaaatggcagatgcgaacaggcctaaaaacaataagtgaaaggcaaacgacggcgtcgtcaatcgctcccagtctatacgaatcttaaaatgccaaattaggggaagcatccagagcaagccgtaaaaaaagacacgtctcgtcacttgaatgatatggtatccatattggttaatgattttcgataaaatagaatagaaggcccagacaatggtcgccgttaatgctagcgcatcaccgattggattcaattggaacgtcgtcattccattaaagctaatcagtacaattcctgtcatcgcgatgaaaaagcctataaaaaaccggcgatgcaaaggctcatctttcaataaaaaataagccaataaaaatgagaagaatggtacaactgagctgatgacacctgcattcgaagcgaacgtataggtgagtgcgacattttctaaaaaatagtataagaccacaccacataaccctgcgagcgcaaacatcgcttcatgctttttacgttgcaccttcatggtgatcggatagatcaacatcagagcgagatatccaataaaaaaccggaaaaataatatttctgttggtgaaaaagccgttaacaatattttggttgagataaaggtcgatccccatagaaaaatggtgaatatggccgctagatgaccaagaagctggttatttttcatctgctgttacctgctttgcaaaaatgtactgatattgccctggtgtgagcccaataaattctgaaaaaaaatgactcaaatgactttgatcagaaaaaccggcggagactgccgcatctacaggcttcactcctcgcgagagaagctccttcgcataattcactctcactgtctgtaaataacgatacggtgtgatccctctgtactttgtaaaagctcgcagaagagagtatttgttcatggacactagctctcctaagtcgtctaacgatatattttccgtaaggtgtgtttcaatatattgctgtacgtcttggactttctgttcggcagcatgcgctgctgatgctttttcctctgatgtatcagcgtaggcttcaatcagctgcttcataaagaaataaaacgtttcctgtttattcaaagctggggcttcttctgtaatcatttgatgaagatcatataatgactttgtcagttcactttgtgaaaacacaggggctttaaaatgtggtttgtactgaaatatcttctctattatatctgcttctatatttaaacagcgataatctaatgtcctgtgatccatctgctcgcatgcgtgattgtcatatggattaaaaagaaggatgtctcccttttcaatgatgtattcttcattttggcaaatcaaacgtctttgaccatcttcaataaatccaatcacatagtatgtatgaaaatgattcgggaacttttgcatgatgccatgaaagcgatacgcctctatttgcaagtcctgatcaaaatgtaccgttcgttcttcttgtgttttcatgtcgatcccctctttcactgaactgatcattagtgtagcacaccctttttctcttgcattgtacgatattgacttttccgatgtaggcttgcctagagggaaaaacttggataacatgagacaaaagatgatgtgtaaatgagggaaggacaggatgaattcattcgagatggaaagaccagcaccataccatatgcaattttatgaacagctgaagcaaatgatttttgatggacagtttcagccaggcgaacgcatcaatgaaacacagcttgccaaacaatttggtgtaagccgatcaccggtgagagaggcgatgaggcttttagaaaaagatgagctcttgatcgctgaccatcggtcgggctactctgtttatacgttaacggaaaaagatgtcgaggagctttatcaaattcggatcgccctagaaacacttgctgtagagcttgcatgcaaagaggccacgccaagagagctggatgaaattgagcaggtcctcacgcaggcagacgaagcaatcaaacagcagctgccatctaaagacatcgttcagctacatgaagcctttcatcaaaaaatcattctagcgagccacaatcaccgcttatataaacaattgaatcatgtgaatgcactcattcatttttgccgtatctttcattttagcggcggggcgcgcgctgagacgattcaaacagagcatgctgccatttattctgaaatgaaagagcgccgctccacagaagccgttcaagcgatgacggatcatttgttacatgatgtgatgcacttaaagcaagtactctctgaaacaaacaaggattaagtgatttttcctttttcccattttttaagcattacatgaacatattttgaatttttcgtagatttcagcatgtcccgacgatctttcgtttatattagaagatgagaaactagcttttatacaggaggatttgtatatgcatacaagtattagccgtcttcgacaggcgggttttattgagggtatgtctcttttgacccttcttttaattgccatgcctctgaaatattttgcggatattccgatggcagtcaccattgtaggctctcttcatggcgcattgtttgtcatctatatgcttattttggcatatgtgacctttaaagttcgctggcatttgaaatggtcgatcgctggtttttttgcggctttcattcctttcggcaacttcgcctatgataaggtgctccgccagtatgatacaaaagcttaatcaaaaagggctaaaacgacattcgttttagccctttttctccttttcagcgtgatagaaaacctttgcagccctaggaaggttggctacttttgcggagcgaatttgacattcgtgagcaccagcacgcaggactgacaccgaatgcgagggtttgtctacacgctgaagtattttttaaatcgatgcatatttcacaatggctgcttgacgtgtcatttcgtgatatgccacccataattcatcacctggcagtacgctagtgatcggatcgattggctgtttcacttcatacatcacgccatctctctcaatctgaatgatcgctaacggctggttgccgatgacaccggaaaatgtgacatgggtcacttttgcacttccttgtttctcttgcataagactgatctctttatccagctcttcttgttttgtctgcatcgtgatttgagttcctggcgcgacctccatatggtcagggatgaattgactgaccgtttttgtgatggattgatctccgctagaaaccgtcacatccagcataataggcttctgatcatgaattgtgactggatattgcttcacccgttggatagttcctgtcaatgtcacgtctttccccgaacgattccgcacttcatgcccataggctgccattttcaactgaccgctgatgtcaacgagatcggctttttctcctgttctaaactcaaaaccagcggcttgaatcatcggaatggtataccttttctgacctgcttcaaatgtaagcgataagacggtgcctcgtcctacggttccatatgattctatgtttcttaaaatagcgcctttgatgaactttggctcgcttggctttgagaagtccccctcttttaagagcatcgcctttttcttcttcggattgtaaagaacgggaatacgctgacccggctgcggtatctgcgtataggatacaaccgttttaaccgtcttctcgatgttttccccatcatattgaaattgcagctgcattttgacaagcggctgttcgttgatgtaggtacccgtttctttgacagatacaatattggcttctaatgtgacactgtccttgatcttattctttctcaccagtctcaaaatcggcggcaggaagatggctagcacaaataacagcagtggaataaacagccaaatcgcccagttgagaatgagcggtccgcctttcatgacatattgcataaaggtgtcaacagacgtttggtgagcaggacttgcgttttcgattgagatgactttttgcaaaggaaattcctttagctgtttgcttttcgtctcaaatgcacccgttaattgattttcgaatgaataatagatccaatcgcttttcacatttttattgaaagagagtccttctctttgtaaagtttcatatgaaaacgactgaaaaagcttggtgacagacgttgtcttattcgtgcgatggttataaatataaccagtcagcttgccttttgcttcgtcctttgctgtagagcctgcaagaagaacttcttcttcattaagctggtagataaaggtttgataaatcggttttggtgttgggacgacttctccaaaccttccctctgcattcactttccttggtctttttggatagttagattcgacagcgactgcgaagttttgggatgttccgatcgttttttccagctgcttctccactttatcttcaatgaggctaaacggttcagcgtttttggtgacatacaccccaagctggttcttatcgtttgagactccgctgacatacgccttctgatcatttttcaaagtcaattcaaatataggaataggcgtctgccctctaaaggaattcatgacgacatcgatggaaacgggtcttgctggcagttttagctcgttgagattgtgcacatgaaactgaccattctttagctcaccaaggaccgcagcggtaccttccatttcccctgtaaacacaagccgcccattccattgatatgtattcgtttttaaaaacgagggtatctgtagattttgcttaacgagctctttcttttccccgctcggcgttagtttctcgatcaacagctgcccctctttattttttaaagcaagtaagaggttgttcccttgaatggatggcagcatttcattaaacgtatcgctttccgtggtccattcactgattctttttcctgattgaggatcatacattccaaaatggagctgctggtcttttgatacagcactcaccactcgtttcccttcatcaaatgtaaatatttgtttgatgtcatattgcgttgctttccctgctgacaaatcaccttggtaatgattccacaccaagacactaagaatgattgctggaataaagaagacaatatacctgaggaaaatcactggtattcttttcacttgatcgcttcctttcatgaggttcctttatcttgtacgttagtgcagcgagaatgtttcatgctagaagaataccattccaactttccaaatccatattttacaaacttggttgtttgcgataaaatccaatcagattcgaaaaaaggatgttatctcaatggataagctatcatcgatcattctagcggcttggctgcgtgttcctcgttggttcaagcaatgggtgcttgtatccatttccattttctttttttatatgtgttttgtaaaggggctgactagctggcacaccttgccgcctgtcactttgctctcatgtgtgattgcttccttcatcatttggctgatgtggcttaaaggtcaaaaaaataaatgaaatggggaaaatcatgaaagaatccatcagttattttgctatctcttttgttctgcaatgggtttggtttggcatcgtgcacccaaataaaggcgtgacactcctagacatgttcatcttttctattttgtttgcggtgatgttcttctttattcggaggatttggcaatatcagaagaaaggccgaagtgagtgatcatgaagcccgccttgttcactgttatcacctgtgcgatcattggcctatttttgatgtcgaagccttttgaagcggacgctatgcgtttggtttctaccttcattttcccttttattgggcttgttggtttcgggttcctattgtttgacccaatgaaaaaggctgccaaatagatggcagccttttctttactcttttcatgcaaataaataatcaatgtttaatctccgttatggagtgtatgaattaagattcgatcatatcagtgtgtcatatgtgttccgaatgaacctacgtttgaaagtaaacgccatggaagttctggataacaagacaacgaaagccctacctctcattcgtccttacggctccgaagccgtgccagtgtgaattgtaaatcaaaacgtcttttttccactcttccgcttttatagggggcgggtgcagaaggaaaagaataagtttgctcgctttgacagcgtctcgttcttatctagtagaagctctattgcttctcattatgtcatagaaaaaagaaagtttactttctttatttatttgcttatttcaacacttaataccatattataacacgttcccccagcttacgcaagtgttaaagtgataattctgctggtgtacgttacgcaagtgttaaagtgataattctgctggtgtacggcttccttcattcatgtaacgaatggaggttggatcaatcttcagaatcactaggttcggatcatcttttcctttaaaccatttctccatttcctcagaccaaaggcggtcgattagatctgaatcgtcggttaatgtggcggtgccttcgatttctgcatacgtatcaccgaatccttcacctgaataaccaatgagaatatggacgttcggatttttttcaatttcatctgctttatgtgtttctttgcttgttggtgtatataatttcagtccctcatgaaaaaaagtcatgtagcgggtatgcggtttatcctgttcaacagtcgccagtgttccgaccttttgttcatctaataggttgagtaccttttgttttaattcttcttgtgacatatcgtttcactccttcaaatttcatccgtattcttaggtttccacgacaatccattcattaaacaaagaaatgtgtttttcataaaaagagagcttctggctgatgctatagaaaacaggctcaatgaagggagaagttgaacatgcatcatgaaacgatgttccatttaagttcacttgtcattgcggcagttgttgtgggcattatcgtatggtctgtctcatctgtgcagaagaatcgcaagaaatactaaagacaccgcccaatcaggtgggcggtgcgctattgatcatgtattcataaaggaaccgccgttgacgtgtagtgtttgtcctgtcatataagacgattcgtcagaagcaagcagtacatagcagccaacatgctctacaggctgtcctggtcttcccattggggtttctgccccgaagctttccacactatcctcatcaaatgtagatggaataagcggcgtccaaattggacctggcgctacaccgttcacccgaattccatctttcacaagcgactgtgccatagaacgcgtaaagccgttaatggccccttttgtcgccgtataatcaatcagcactttgttgcctcgatatgggttaatggaagttgtattaataattgaacttcctggttttaagtaatccagtgctttcttcgtaaaataaaaataagaatagaagttggttctaaaggtttggtgaagctgctcactagaaatatcctgaatccgttctttcgggtgctgttcagccgcattattcactaaaatatctaattgcccaaaggcttcaactgttttttctaccgctttctcgcaaaatgcttcgtcaccgacatctcctgcaatcgttaaacatttgacgccttcctgttctacgcgcttttgcgtatcctttgcatcctcatgttcatttaagtacacaatggcgacgtgtgccccttcttttgcataggcaacagatacagcacgtccaattccactatctccgcctgtaatcaatgcaactttccctttaagcttgccagacccttgatatgattcatcctcaaagatcggcgcagggttcatttccctttcactgcctggctgctgattctgcgtttggcgcggaatgccatttgttaaatattcacgtaaatccatgagtaagctcctccttgatttgttgatgtatcctttcattaccacctcattttttcactcaaacatccctatgcggcacagatgcgttttgaaaatcggcatgtttcaagatggataaaatcggttacatgatcaataaaaaggagcgttctcaaatgctgtcaaccatttcgaaaacctttagcaaaccaaaaggctggctcggaagcatcgcaggcttcattatggcaaaagaaaataaagcgttgaatcagtgggccatccagcacttagatctgacagatggtgaaaacattttggaaatcggctatgggcccggctacagcatcaagcatatgcttaagcattataaagatcttcatatagatgggctagatgcttcatcgaccatgcaggagcaagcacagtcccgcgtcagcaaacggtcaaaggacaaacaagtccggctgtatgtaggtaaaattgagaaaacacgtttgccgggagagcagtatgacaaagtgctgtctgtgaacaactttacgatttgggatgatccaaagactggcctgctcaacctttatcacacgttgaaacccggcggaaagctcgtcattgtgatgcagccaagagaaaaagatgctgatgcgagccggacaaaagagatgggtgaacatatattgaatgatctacagtttgcagggtttgaccatttttctgttgagtatgaggaaattcgtccaacgcttgctgtctgtgtcacagccaaaaagccgagaaacgaataagctctcggctttttttcttaccattttgcttcttttacaaattgatagaacagctgatgcaatttctgttcaatgtcttcctttgatccatgaccataaagtgtcatgctttcctcactttcaatgatagaggaactgatcagactaaacatttctgacccttccttgcctagctcttgcggcgccagcatcatgagcattcgtgacatctgctgctgcccgccgtccatgcttttcacctcgtatgcctgatcaagatcatacatatgaaagattggttccttgatgaatgcatgctttaaatgaaaaagagcaaattctgtaccaggaatccctaagccgccttgctgttcacgttctagtaaaccgcttgctacctcatccgcatgtgtgataaacccttcatcttcaagctgacgaagcagctgcctgattgtagcctcatgctgcggcatcgccattctattttcgatggtaaaatgggacaggatgctgcgaatcacaaacatgtaattcgtcacctgctctgcaaccgccatcatattaacggattcttgtaccggttctttggcagcttctttcatcctttttttctcgatcatgtaagggatctttcgtttaatatgagccttcacacgcatagcatcatcctcgtttaagagcggactgaccatgatgtaatcgatatgctcatatgggatagggacggtcgagacaatcatgtcatagcttgatgcatcgatttcttttagttccatcaaggaagacagatcaaattcggcgatctccggcaattctttttttaaacgagatgcgagcattttcgacgaaccgatgccgcttgagcacacgaccaatgcatgaatgttcgtttcttcttttttgatttcaagcactgagccaaagtgaagcacaataaaggcgatttcatcctctggaaattcgatctctggaaagaaacgctcgactccttcttcaattgccatgaaaagcaaaaagtagtcctttttaatttgttgtgtaagtggattatagattctcatcttttcctttaaacggttcatggcaggttcgagatgagacacgagtccctcatacaatgaatcattctcatttaaatggtagccggttttatttgaaataaaatcaatgagcttcttcgttctaattgcgatatccagctcgatttcatcaatacggtattctgccccaaagctgcggtttgcactgcgcagatggatggtcatatatccaacttctgcttccgggatctcgacattaaacatgcgttcaagcgctcttgcgattcgcagtgatgattcaaattctttcgtccgctttagttcaagcagctcttcctcttccatgcgaatggtttcgccaagctgaatccgttcaatggcataggttaagtgaacgacaagcgcaatataggcgctatcagataaagagagtgacagtctattttttaaatgaaagagcagtctttctaccttaagcagctgccctctgctgacaacgccaaacaccttttccgtcgctttcgttcgatgcttgatattcatttcaattgtttctaaaaataattgaatatcgagccggtcgacaatgaggttgccgacaatctttcgtttcgcttcctccggtccttttaattcaatgccatacccgcgttttcggatcagctgcaaaccgtaaggcgcgatccactccgtcagttcatctaagtcatagctgatggtcgcatttgtgacctgcaaatcggcagcgagtgtatataatttcaccggttcctttgcttcaagcagcgcacataggattaagagcttccgttcgtcagagctatattcaatttgatcctcatttgacatatgagcaagaagccgctgtttatcctcctgttcaccgactgccttcaagcctttccccggctgtttatctagtgaaaggtcataattctttaatatgggtttaatcgattttagttctctatgaatcgttcttgtactcacctgaacagaatcggctatctcacgaatggtgacataacgattttgctggatgatgtatttgatgatcttctgttctcttgccgttatgtacatgaaatgcctccttctgcaaaaataggtctattgtcacaccttaatataaaacgctttcaacaaacgatgcaatcttaagttgatctgactttggcacatcagctgtgacaaaattaaatacaacatctgatcatacatttctccaaaatgacggtccataatccttttgatgaaattgaaccttctgttcatgaaaaggcagtgaacccccagcttttaaagaatacgtcggattgtatactggagagccaaagcaataatccatcgttccttcttccgggcgaaagatgacggttcgcattgttccaaacagctcctcataattgtgcacagctagaccatcaggatattctgtctgaaacagcttagtaagagaatcacttgatcgtcgttgttctaaagcctccagtaacatgtcgtatctgacaacagaatgatgtttcgtcattccttttgccgtttgatcagcaagcggatggtttgtggctgcaatataacctgcctccggtcttctcactattttcaggccatcaatgatttcaatcacagccgcttctccttttcgatcggcaagcataaggtgaacattagaggcaacaggcatttcctgaatagagaaaatggcttcctcaaccgttctacaggtttccagaacagaccgtatcacatgatacacttgcaagccggcaactgccggaggctttaaacctggttcatttccaaccggcggaccacatgcagagaatgtgacagaaagaccatgctcattcatcccatcagatctgccaaacaagagcagcgacgagcctgtatgatatgccaagccctccacatgtgtcgtcacaagacgcatatcttcaaatatcggggaaaaatcatagtttcgcagcatgatcgtttcttgacctgcccccatatttccctgcctcacacagtgggaacagcctggctttagatgagatgaatagtaaaaggtcaaataacgctcatccaattgcagttcatcacaaaatccagcaatctcttcttctaactggggaagatatgggcgcatcagctgcttcgtttctttcacagcctctttttcaagcggttctgttcgaatgtattgtgtctgtagcccttgcttcttcttcatccagacagcctgctgctttcccacttcataagcggttcctgtcatttcttgaaaatatgcactgatttcctccatgcctgaacacctctttcaccttcgtttcttttatcatatcgaaacactccttcatttaaaaggatgaaaaaaactgcaatcccaatggattacagctgtttgcaggattgttgaaacaatgtttttgccattgcttcatatcctttatgatttggatgaaattgatcaatcgataagtactcatgttcatgtccttcaaacgcccggtacacatccacgacctctacatgtggatttgcagcaagcgagcgaagctgatgattgtattgctgaagccaccgcccggctattggtatttgcggaaaaggattatataaattcatgagatatatgcaataggcctgcttctgtccctttttgatctgagcgatttcttgaatcattttgttgaaatttacttggcaatgcagtgtcgcttgcagcagtttcttttcatcttcacccttttcatactgctgaatcgcttgaacaaggtcattcccacaacctgtgatagtgatgatgtcagctgctgcaatagcacgtcttacatcagatcgtttgaacagctgtaaaatctgatccgtcgttaaccctgactttgcaaatacagacagctcgactggtgtatgtgtctttttttcaagcatccactgataccgctctgcgaagcctccgccaaataaacgtgcccccactccaactgttaaggaatctccaatcgcaacataggatcgtcccactcttatccctcactctctcctgccttctcttatatatacgaaatcggagaacagatgcttgtagcagatgacttagagacattcatctttttttcatgagacgtctttacaaactcttcacttgcgagatcggctgattttttgttcaataagaataggtttagatcatgaagtttgcacctgcatgcgttccagaaaaatttacaaactttttatcttgatttcgagactttataccttgacttcaaactacattgtgattacaataaaaatatcagtttttatgtaactgtgcttgttacatctttttcatagcattccaatatgattaaagatgccacatattcagtgtatctttgggatacgctaaaaaaatcactgaaacagaaaggattgaatgaacatggcaaaagttttatacatcactgcacatccgcatgatgaaacagtttcttacagtatggctactgctaaagcatttatcgaatcttataaggaagcaaacccaagtgacgaggttgtacatatcgacttgtacaaagaaaacatccctcacattgatgcagatgtattcgctggctggggcaagctgcaatcaggtgctggcttcgatacactttcagctgaagagcaagcgaaagttgctcgcctaaacgaattaagcgatcaattcgtttctgctgacaaatatgtatttgtttcaccactttggaacttctcattcccaccagttcttaaagcatacatcgactctgttgctgtagctggtaaaacattcaaatacactgagcaaggtcctgttggattattaacagacaaaaaagctctacacatccaagcacgtggcggatactacactgaaggtcctgctgctgaacttgaagcaggccaccgttaccttggtacaattgcgagcttcttcggaattccttctttcgaaggtcttatcgttgaaggtcacaatgctgaacctgcgaaagcagagcaaattaaagcagatgcgatcgaacgtgcaaaagctttaggtaaaactttctaattaactgaacacgaaaagccaatgatcttaacggtcattggctttttatttatctagatgaaagcctaattctctggagataccgctcgcggcttttttgacttgttcaattaagtatggaagacgttccttttgatatcctgcttcaaaccctgcaatgctaatacctgctgtgacttctccaaggtgattgaatataggagctccaaccgcagctgtatagttttcaagctccgaataacttaacgtatagccccgttcatttgattcttccagtatgtttcgaagaacctctttatctgtaatggtcccgattccgattttccctagctcaatcgaatcgatataggcaagtctctcgttctctggcaaaaaggagagaatacttcttgcacaagcacccgcatataaaggagagcgcctgccaacggcggtgtagagacgaacaggctgcgtcccttcaattttatccacgtaaatggcttcgtctccttcacgaacgatgagttgtacagcttctcccacttcatcccgcaagccttccataaatggtcttgcaattctccgaatatcaaggcgttccgccacaagctgaccgtattctagaaacatcaggcctaaccgataaacgcctgaatcttgcttttctaataaccccatatcggttaacgagctcgccatgcggtgcacagacgttttcggcatgcaggaaagctcgatcatttcattcaatgttaattggtcacgtgtgataaacagccgcaaaatctccattgatttcacgacggttttatttgtgttttgcatgtgcatcctcttttctaaacgaaggcttccagcttgattctggcagccagctccttcagttctgcttcttgcttaaatagcgcctgctctgcatcctgatggtcgattcgcttaaaatacaaattcgccccaggcatcgcttgagcaatgagtggcaggtcgaccgtcgcaacttctccaatccgcgggtatccgcctgttgtttgccgatctgccagcagaataatcggctgaccgtcaggaggaatttgaatagaaccaaaggcaaccgcctctgaaatcaattcaagcttttcttttaaatgaaccggctcccccttcaaacggcagcccatacgatctgattgaggcgtgatttgataaggctgctcaaaaaaggtgctttgagatgattcttgaaaaaaagaaaggtgtctccctgacagcacccgaatcacgggcgatttccgcagcggtaaaaaatgcgtatgacttacagtccaatcgggtgcgctgtacgccgcctgttttagattgcttttgagtctatcagacaatcgatccgctacgattgaaggctttccaacggacaggacgtctcctttttcaagcggacgtccgttcagtccaccgattcctgctctcacataggtgcttttgctctccatgaccggctccacatcgaatccacctgccacagcaatgtaagagcggcaccccctcttgcaaggaccaaaggtgatcgtgcttcctgatcgaacaaagagtggtttccataaaggggctggctctccatcaatatcgatctccacatcagcgccagtcactgcaataagctcatccttttgacacgtcagcacagggcccggccccattaatgtgatttccagtacggcttcgttttcctcgttgcctgtgagaatgttggcaattctaagtgagagcgtgtccatgccgccgctcgttaagacgccatacttttgatagcctttccgtcctttatcttgaatggttgtgaacattcctgacttgatgacatggatactcaacgttctgcctccttcatgctgaaaaattccttttcagacatttggacaaatctaacctcgtctcctgctcttaatagacttgggactttttcgtctggacgaaagagtggcagcggggtttgtccgatgagctgccagccgccaggtgtggaaatcgggtatacgccggtctgctttcccgcaatgccgacagatccttttggaatagacattctcggtgtttcccttcgcggggctgcgatcctttcagacagcccgcctaaaaacggaaatcctggtgcaaatccaatcatatagacaagatacgttccgccagtgtgaatacgcacgacttcctctggtgttaaacgattgatccgggcgacttcttctaaatcagggccaagctctcccccatagcagaccggtatgtcgatggtgcggcgctgaatctgatccccctcctgccatttctcttcaaggagtgtttcaatatagcttttcacccattcatagggggataagtctagttgctgaagatgcgccgattgataaacggtatacggctcgtaaaaaacagtcacgtttgtaaaggcttgaacagcttccacatatccgtcaaatggatgctgttcaatacatgaaaacaactgcacaacacgttcatgaatttcttcacatatgtctgttcctgcttgaatcacgattgctgcatctcctagcgggtggaaggtgaaagaatcttttatcgttgaaaatgccacttgaggacccctctctttctaaagcacaccgagctgttgatctcgttgatctgtgatgaacatatgcccaggtgcatgggtaatcgcaatctctggttttgtatgcatgacaatggcttgcggcgtcacaccacatgcccaaaacaccgggacctctccttctttgatgacggatggttctccaaagtccggctgatccacatgagcaattccaatcatcgctgggtcacctatatggatgggaccgccgtgaactgatgggaatctagacgtcacttgtacacttcttgtgatctgatgcgccggaatgggtctcatgctgacgaccattgggccatgaaatacccccgccctttcacaagcgatattcgtttgatacatcggaacgttatgaccgttttcaatatggcgaacagggatatcattcagcatgagcgcatgctcaaacgtaaaactgcagccgatgagaaaggcaaccatatcatcttcccaataagtagagatatctgacacctcttcttgaagaatcccttttctgtaaatacggtatttaggaaagtccgtacgaatatccgcttggggtgctgaccttctcggcactggatcacctggctccagtacatccagcaaggggcatgcagccggattgcgttgacaaaacaacagaaaatcaaaagcaagttcctttttgacgatcattaaattggcttgagcatatccctctgccaggcctgccgtcggtcctgtgatttcttttttacgaatcaactctctaatctgtgaaggctcatatgtttgatagatattcattcgattcagctccatagttttggaatttcattgatgatggtatatccgcccatcattgccatgatgacaacgacaaatgcgcctgatactgtcaaaaagaatggatgtcgataatccccgacaatgtctttcttataagccgctaccagcaaggtgccaagcgcgagcggtaagatcaatgcattgatcgccccaactaatatcaatatgttcacaggtcttccgatcgtaataaaacaaatggtcgagagggcaataaagccgatgataatgccacgttgattttgctcaatttttggtgagaaggttttaaagaaggaaacggatgtatatgctgctccaatgacggacgtaatcgccgctgcccacataatgatcccgaacattttatagccaacatttccagacgctaactggaatactgaagcaggcggattcgctgggtcaatctgtaagccctttgaaaccactcctagcacggctaaaaataaagcgacacgcatcacagatgtaatcaggatgccgaaaacagagctttttgtcacttgaggaagtgcatccttccctttaattccagcatctaatagacgatgtccaccagcaaaaacgatatagccgccaactgtccccccgacaagtgtcacaatcgatagaatatcaatttcttctgggacaaaggttctgagtgccgcttccccaactggcggtgctgttgaaatcgccacataaagcatcaggccgatcatgacaaagcccgctatctgtgtgaaacggtccatcgctttaccagcctctttaatcacaaaaatcagaatggcaatggcagcactgatggctgctccaattcgcggatcaactcctgtgatcacctgaaaaccgagaccagcaccagcaatatttccgatgttaaaggcaagtcctcccatgacaatcaaaacagccagtacatatccgagacccggcagaaccatatttgcaatctcctgccctcgtttctctgacacggcgataatgcgccatacattggtttgcgcaaaaatatctaacaaaatagagatgaaaatgacaaacccaaagctagccgcaagctgctgcgtgaagacagtcgtttgtgttaaaaatcccggtccgatggcggacgtcgccattaaaaaggctgcgcccatcagcatagaccggttcccctttgatgccttcttgtgcttcacttcctgttttttcatgctgtttccccctttgatgacgacttttattgaaaggccttgagatgaatgcttgcttctttaagcttcgatgtaatggttttggcaaattggagcgcatggatgccgtctccgtgtatacagaccgtatctgctttaagcgaaatatcttccccttgaacggtatgaaccttcccttccctcaccatacgaacaaccttcttgactgccagttcatcgtcttcaatgagtgcatgcggttcacggcgcgatgtcagcgtcccgtctttttgataggtccgatcagaaaacacttcatgcgccacttgaagacccattctctcacctgctaacgcaagttcactgcctgaaagcccgtataatacaagacttggatcgacatgatacacagccttcgcaattgattcagataattcagtatttttagccgccatgttgtacagggcgccgtgtggcttgacatgctgcatcgtgccgccttctgcctgaagaaaggctgatagagcgccaatttgatagacgacgagatcataggcttcctctgctgaaatcgccattggacgtctgccaaagccgactaaatcttgcagacccggatgagcaccaatttgcacccctttatccaatgccattctgacggtttttctcatcaccgttggatctcctgcatgaaaaccgcaagcaatgttggctgaggtgacatattctaaaatttgttcatctgaaccgattgtatattggccaaagctttctcccaaatcacagttgatatctacttgatacataggatcccccctttttgttccgaataacggaacttgaagtccgaatattcgaatttatattgattatatcaattttggctagtttgcacatgacattgttagaaaacataacaatagaactaggagaaataaaaaaacgagaggatatcacctctcgtttttttatttatttagacagcacccaatgatggatcgcttttgctacaccgtgttctgtgttaggagctgtaatccaatcagcagcttctttcaccacttcttgcgcatttcccatcgcaatgcctaatccggcttcttggatcatagccatatcatttaggctgtcgccaagtgacatgacattgtccatcgtacagccaatgcgttctgctacctttgcaagagctgccgctttgttaatgccagctgcattaacttcaatattagtcggacttgaatttgtgatttctagatgctcgtttgttttcaatgtattgagtacttcctcacgaacgttatcatcatgaatatcaaagccaaatttcaaccattcatggtcatgaattcgttctgggaattcacctctccacaccttatccacagtggaagcccagtaatcggtttcgtacctattttttagatcccacatcatctggacatgatcaggatgcagcagatctcgttcgatcagctggaagtttgaatcccaaatttcacttccgtttgctgtcacaaggtaagaagacagcttaagcggctccaccagctctcggcatgtcatcagtgtgcgccctgtgctaatcaccacatggaccccttttgcttcagcatctttaatggcttgtttattttcctctggaatgacgtgttcactgtttaacagcgtgccatccatatcaatggcaatcaatcggatgtctttcttatcagcttgtattgacaaattgagtaccccactttgtatcatttttgtttactatctttattttaatataaagaggaagatggcacaaagggacgagtttgatcccatagaaaaaagacctgattgcaggtctctttacataggcttagcgttcacacgcaatgccgtctttatcacggtcaaggtgcttatttttgagataaagcgcttttgatgcatacggcttgtactttgttttgccgcctttgtttttcgtgtttttgctttttgccacgccgcctttatagactttattcagcgatttgcagtttttatacttcactgtctttgcatctgctgtatggctgtcgacttgtgtaaagcttagtaaaagacctaaagacaagacagccaccatgattttttttaacatgtagaatccccctgttttttctatttttacatttttatcatatgtcaccactttttgtttttcaagactattgtgctaaaaaatagatttttttggaataaatcatgctttatatcctatatggtacactgagtgggaaacctttccggttttgacacgtatatgaagagaggagtttttcacatgaaaatgaaatataccattctatatgtaaacgatgttgaggcaagtattcatttttatcaacatgtacttggctttcctatgaaacttagggttgaatcctatgttgagtttgatactggagatgtgaccctatcaattaactcacgtcaggatgtcaaagatgcacttggattgcctgtcccagaagccaatcaatcctctcaaacgttcgagatagggtttgttgtggatgacgtggaacaaaccattgcatcaatgaaggaaaaaggggtttcgattattaaagaacctgcaaaaaaaccatggggtcaaaccgtcgcttatgtcgctgatcctgatggtcatttcattgaaatatgtgatgcggtctcctaatcttctttaaaggagtgaaccagtatgagaaaaaaacatgcctttatcgccggtgtttgctcaatgattgtggttagcagtgccgctattattttgcagcaccatgagtggataggatggatcagtggtggtatctctattatcgggatcatgatgtctgggcttctaatgggggcttggacaagcggagatgaaacaagagccgcctatcattctgaaacgaaagagcaccgcatgtggcgtctggatacggcctttctcatgatgatctttgcacttccgcacatggcagtgtcgatcttttattttttaatgtaaacacttgttaaaaggagttcgtcatatggctgtttttattttattcgttgtatttggcttccctattctttctgtgctgattggcatttttggcacaatgcttttgaagaatgtttggatgccgactttgattgtcctgttagccagcgtcattctcatgtacacatacattggcggggaggaatcctttctcatttgggtcattatctacaccgtctttacgttgatcgctgcatggatgacaaagcggtttcggttcaagtaaaaaagaacagtttgcactgttctttttttgatcaaatatcggcgcaccatagctcaatttcaattttcagctcaggccatcctaaagctgatacataagcaaccgtcattgatgggtaagctgttttgaagatcgtatcccactgaggatatagatgatcccagtcaatttcttccgttgcccatatattgaccttgatgacatgctcttcattcaatccttctgattcaagaatttttttgatattttcaaacgtattggttacctggtcgtttaaacttgatggcacttgtccatcgatatctgttccgacttgacccgatgtaacaaataatcccgcgccctttggtactcgtgtgatatgactatagctgccaacgggcttcggcatactttctgggtttttccttatgattttttccatgtgatttccctcactcactttgatttttctgctagtcttctcttcatgtagacagacttcaccaatttctatctatcctaaaagaaaacagcagtggagtatccatagccacaaggcaagaacatcaatattttctttttcatgaccggaacactcctttcgattgcgtgagcaaggttttgattccttatatagtacctgacaaaagacgttcagtcaaaatggtttatagacgataacgcgcaatatcgtgattcaaccgtatgcttagttcattgagtctttctgctgcttttgccacattggagatggctgtcacctgttcgtctgtggatgcggtaatctcttcgatcgcagcggcattttcttgagaaatatgggctgcgccttgcatggcttttgtgatgaggtcgttttgctccagcaatgcattcagctcttttgccatggcgtctgtttcaacgatggtttgtgaaatcgacgtagagatggcattgaattcatgttctgtcgcatgtaccgcttcatctaactcagcgaaacgatccattgtgtttgacatcatgccggctgttgccgtcgtttcttctttaatgccttgtaccatttgctgaatttgcactgctgattgttttgtctgctcagctaaattccgtacttcactcgccacaaccgagaaacccttgccgtgctctcctgcgcgtgctgcttcaatgctggcattcagcgcaagtaaattcgtctcgtttgaaatgctttcaatcgtatctgtaattttagagatatcctgtacttttgtacttaattgctcaatgcctgctctaatgccttgagatgcttgaatggattgtttatttgattgttttaattgctgaacaatttgctgaccctgctgagaagattgactcgattggtcagagattcgtttaatttggtcactttgttctttgacattctcaatggattgattgaactgggtcatttgttggttcgctacatcaaggtcagatgcctgatgaagtgttccagtcgatatgtcaccaatcgctctgccaatctcttcactgctggctgaggtttcttcagatattgctgataaatctgtcgctgattcgacaagttgactgctcgtttcctgtagaccgctgacaagtgtccggagttctcctgacatatgattaaagccttttgccagctgtccaatctcatctgttgtttcttttaaacttgtgcgttcaagattccccgccgcaatttcttttgaagcagcagtgacttgcttgagcagtctgacctttcctcgagcagctaaataaaagacgccaagactgagaagagcgacacccgctgtaatgagcatgatatagagcttcatctgctctaattctttataaaattcatcctgaaagacggcaatgccgatactccaattccaaggcgtgaactggctcatataggcaagcttttgcttttcttccccagtggcatcatccttatctaaataggtcacatagtgtgcatcctcgccttctgatttggctccagcgaccattttttcacgattggtcgtattatctggaatgacgccaatgtcattgacaggatggacttgagaggaataatctgctccatatgcgacaagatagcctttatttttatagataaaatctgatttttgaaattggtaccctttcccgttgtcatttttgggcccgctcaagtaaatacgggcttgttcctgtgcctgttcaagcgtcagttcttttttctctacacgatcattcaactgttcaagtgtagccattgctccgctgacgatgtgctttagatctgcttttcccgcatcaattaagacatgttttgctaacaaataccccgttgttccaacaagaccgccagttaaaatcgtgatgacgataatggcagacattaattgaaaaaagacacttcttgacgcaaacattttccttttcatatacaaattcccccttacttcatatatcgacaaacggggtaaagtcttaaaaaagtcatcaaaaaacccctttcactcgttggaaagggattttctgattatcgagctgtttctttaagaatggcttgatagagatcgtctgttggcgtgagaccacatacttctttcagcacaccttcaatgcctttttcttttcttaatgcctgcaaacgaaccgcttcttcgtcttcggtaaagtcataagcgagagctgcagcaatgcctttgattaagtacactggctgcttgatctttttcgctggaccgattaaacggtcatctgctcccagctttctaagaggagagcgtgcgacacgagtgacttcgtcggagataaaagcattttcgaatcgcttgatgattttttgaatatacgcatcatgttcttctttttcaaaaccatatgtgtcgattaaataacggcccgtttcgtgaagtgcaccttcaaccacttggcgaatctctgatgtatcgacggcttctttaatcgtttgaacgccttgctgatatccgacataagctgctagcgcatgtcctgtattgacagtaaagagcttgcgctcaatataaggtgtcaaatcttgtacaaaggtcgctccgtcaatctgaggaacgtccccaataaaggcagtctcatcaatgacccactcaaaaaaaggctcgactgatacttttaaaatatcctcatggtgctgaatcggtacaatgcggtccacagcagcgtttggaaaaccaactgtttgtgacagtgctttttgttcctcttctgttagatgagagaaaacggcttcttttaaatgagagctgcccccaatcatattttcacatgccacgatgttgatgatatggtcaggttttttctgttttaatccttcagcaatagatgaagcaatgatcttcaaaacagctggtccaacagctgttgtaatcaaatcggctgatgccacagcctctgttaatgccgctgggtcttgtgcagaattgatcgctgtcactgggccgactacttcttgcttctgacctggtgctgctagttcaaccgtgtattctcctcgtgcattcagctcgttgatgaccgcttcatttacatcggtaaagacaagctcaaagcctgatgcttttaacaaagatccgataaaccctctgccaatattccctgctccaaaatgaagtgccttcatgctagttcacctcgttaaagatggcgatcagttcatcctgatccttcgcatggatgatgcgttctacattttcctcttctgaacaaacaatcgcaatttgagaaagaatatcgaggtgttcgttgtttttacctgcgatgccaaagacgactttggcgatatttccttcgccgtattcaacgccatctggaatttgaatgatggaaatcccagaatgaaggacagctgctttcgcatcctctgttccatgaggaatcgcaatcccgttgcccataaatgtagacgaaatattttctctttcaaacattttgtcaacataatcacctgtgacatagccatttgccactagaacttcacctgcttttttaatggcttcttctttcgagcctgcttgttcgtttagaaaaatattgtcttttgatagtacttgtttcatgaatgatcacacctttttttagaatggaaaatcaggaaaacaaccaaaacggggagttcaatgaagaaaaattgaactcaacccgtttcgtcatgttattttttcaatttctcaatcagctcatcgtatttcgggctgtttaagaaattatcgactgagatatgcacagcgcctggcagttttgccttggctctgtctgttaaatctttatgagtgaagaccacatcggcatcatttggaatgttgctgatggatgtatttgtcacatcaatatcaagctctgcctttttgactttattctttaagatggatgcgcccatcgcgcttgagcccattcctgcatcgcaggcaaagatgattttgttcacttcatctggattgacatcacttggagatgctgcttgctcatttgcttcagcgtcttctttttgtgctgtaagagcagcggctgctgcgcttttcttccctttcatgtcctgcattttttctgttgcggctgttaagtcttcgtcaactgcttttgaggcttttaaaatcacagaagcgacaaggaatgagacgacggctgccacgacgacacctgctagaacagcaagatgtccgccttttggtgacatcagcataagggcgataatacttcctggtgacggcacagcctttaagcctgcatttaacagggtaaaggtcaaaacgccactcgctccccctgcaattaccgctaaaataagctttggtttcattaagatgtacgggaagtaaatctcatgaatccctcctaaaaattgaatgacaatcgcacccggtgcagactgctttgcattccctcttccgaagaacatgtatgcaagtagaacacctaaacctggtcctgggttagtttcaagcaagaacagaacagactgccctgtcttcgccgcttgctctacccctaacggacctaagatcccttggttaatcgcattgtttaagaacaagactttcgctggttcaatgaaaatacttgccagcggaagcaaatgtgcattcacaatgatatctacacctgccgcaagggctttatttagaccaagtacaactggtccgatagcatagaaggcaatcgcgacaagaatggcacctagaatccctgccgtaaagttattcacaagcatctcaaagcccgatttgattcgatctttgaagagctgatcaattttcttaatcaagtaaccgccaagtggtcccatgatcatggcacctaaaaacattggaatgtccgaaccgacaatgaccccaatcgtcgcggttgcaccgagtacaccgcctcgatggtcgtatacgagtttaccgcctgtgtaaccaattaagagtggcagtaagtagttgatcattggaccaacaagtgaagctaattgctcatttggcaaataaccactcggaatgaataatgccgtaatgagtccccaagcgataaatgcgccaatattcggcataatcatgccgcttaaatagcttccaaagcgctgtacttttacgcggaatccgcttttttcctgcatctatgaaaactcctttcttctctccctttattcagggctttataggtcaaaagatataagaacaagtgtcagtgaagcccttatccctatcgtaaaacgctttcactttcccttcaattgaaactaaatgtcactttgtcacttagtgtgtgacaaaattgaaatatgatgtgaattctctgtcagaacatagggcaatcggggtaaaaaggttaacgtgccgtggttttgacgcaaaattcattggaatttcacaattttcaaatcgtcacttcttgtttcctcttcttaaatcgaataggcttatacttgatcaaacctattcaatcaagaatgtctgcgcagacacgacacagaaaaagtgaaccatcttgctgtttgtttcgtttaccttttagagtgagcggcacaataggaggagcggttttttctgtgacccacagtttactgccgctttctttctgatacatgagacattttcataggtagaaaggcggttatacacttgttgaaacatagtaagtggcttctgcttcttatcgtcacgttcgcttttttcattccaaaggaagcatttgcccatgcatacgtcgtcagctcgaatccagcagcaaatgaagagctggagaagcagcctccttcggtctctatcacatttagtgaaggaatcgaaagtggatttcatgccattaaggtgctaaatgcaaaaggggatcgtgtggatcaaggagatacggtcattaaagatcaaaaaatcatggaagctgctttaaaaaaggatttaccaaaggggatttatactattcagtggaatgcggtatcagcagacggacactctgtctctggcatgatcccgtttagtattggcaaagcggatggcggttttgaccaattagatcaaggtcaaccaaatgaatcgattgatgttgcctcgaccatagacaaagcctttctttatacgtcgtttagcttatttctcgggaccattttgtttggactgttttggtttcgggcagcgatttcacctgtattagcgaaacgaatgaaacggctgttgtcattgtcactgatcatgatgggcggagcgctcgtgttccagctgccgattcaaacaaaatcagcggcagacgtgtcctttttgggagcatttcagccatcgcttttacaagaaaccattgcatcgacttctggcggtaatttgtggatgatgctcatggtgtcatttgttcttctgaccatttggagcatcgttgcgatgaaaaaaggggatttcacttcttttcgggtatggttgtttccactgctcctattcgcagtacttctctggctgaaggcacaaatcggacatccagcggcaactgataataaaatactgacaacgtcacttgattttatccatctcgtttctgcatcgatctgggtcggtggtttaacagccattgtgcttttattgttgaagaagctgccaaatgaagatcagccgctcatacggaatacgttaaaggcgtttcacccttgggcactgctctctgttggactcattgtgttttcgggatttgtgaatgcgatctttattttgcaatcgtttgatgctcttttcgaatcagcatacggtcgaacctttttaatcaagcttggtttatttatcttgatgggccttcttgggcttgtccattacttgatgctgagatgggaaaagaaacagaaacaaaacgtttcgttacgagctgagtggatcatcggaatcgctattttgttattaacagctgtattcaccaatattccgagccctcctccgcctgcacctgagccgttcttcggtgcaaaccaagtggagcatcgtgacattgtgtccatgagcattaccccgaatgccccggggaaaaacacattcgaggtcgcatttacaaagaaggatggacaaacgattacagatattcaatctgtgtcagccaagatccataaagtcgccttattcggtgaagagaaaccgagtgaatttcagctgaaacgattaaaaaatggtcattactctgctgaaaacctcttgttaaatgaaaaaggcacttggaaaattgaaatccatgcgttaactggttcttttgaaaatatcgataccacatttattagaagaaactaaaaggagttcataccatatgaaaaaatatgttaaagctttattaccaatgcttctcgcttcatttttattggcgattcctgtgagtgctcacgtcacagtcaaacctgatacgtctgcgacaaatgcttgggaaacctatacgttaaaagttccttctgagagtgacagtccaacgactaaggttgtcgtgacaatacctaaaggcgtagaattccaacaatatgagcctgtccctggatggaaaacatcaactgaagaaaaagatggcaaggtaacaagagtgacttgggaagcaactggtaaaggcgtgcttgccggacagttccagcaattcgtttttgtagcaaaaaaccctgaaaaagcaggtgaagctgcatgggatgcatatcaatattataaggatggaacggtcgttgaatggactggcgataaagatgctgataagccgcattcgatcacaaacattgtcgcatctaatacggtaacggattcccatggtcaagaaaaaccaaaagaagaaaaggcatctgaaacagcctctaattctccttcaccacttgtgctagggttgtccattgctgctctagtcgtagcactgattgcgcttgtgcttgcttttagaaagaaataattcatttgtaagcgatcgttttcacggaaacgatcgctttgtttttccaccttgcttgaacacgaaatgcaagctaggacgatcaactcccatttcctcagcctattattaccaacataggattgaataggatgatgacgcatgccataatgagacacatgaccacctaggaggctataagatgaaccatctaattatatttgctcatccccagcaaagcttaaatcaaaccctattagatcttgttgtcagcactcttttgaacaatggtcatcaagtgactgttcgtgatgtttatgctcttggtttttcaccagaactaaacatcttggaaaaggctgcgatcaaacggggtgatgtccccattaccattcaaacagagcagaagctgattcagaaagcagatgtcctaacatttattttccccatttggtggacaggcttacccgctatgctaaagggctatgtagaacgcgttttttctgagggcttcgcttatcaaatcaatgagcacggggctattgataacctgcttcgacacaaaaaaggtgtcataatcaacacgcacgatgctccaagatcctttcttgacgctaaccgaatcgttcccgcctcccatcgcatgacaacggatacagatgtcttcaattttattggtattgagcctgttgaacgacttttgttcagcagcatggagcaggcaccagcagattacatccacgaaattctgaaagaaacaaaagaaacggttgagcagctttttccgccggctgtttaacataaaaaagactgccaagatacatcaggcagtctcagattgttgacaaagggctaaaatgatctttatttagccctttgtcttcttttcagcgtgatagaaaacctttgcaggctaggaaggacgagcaccggagcggagcgaatttgacattcgtgagcaccgaagcgcagacctgacaccgaatgcgagggtttgtctacacgctgagactgccagattcctcaggcagtctctttcacgtttattcgtctaaaccaatggatacatatttggtttctaaataaggctcgatcccttcgatgccgccttcacggccaattccgctttctttcattcctccgaatggtgcttgaacagccgatgggccgccatcattccagccaataatcccgtaatcaagattctctgagatgtagaggccgtttcgataattctctgtaaagaaataagctgcaagaccaaacggtgtatcgttcgctaattcaatcgcttcatctagcgttttgaatgtcgtaatcggtgccactggcccaaaggtttcttcatgcataatgttcatcgaagggtccacatgtgtgagaaccgttggctggacaaaataatacgacttgtcatcatcgaaatgcgtatctccgccgacaaggattttcgcccctttttcgactgcatcttgaatttggctgacaattttatcaaagccgcgcttgttgataattgggccgatggatgtgccttcttcaaagccatttcccactttcagcttttcgacctctttgctaaagacttgagcaaatgcttcatgaatgtcttcatgcacaattaagcggttggcacagacacaggtttgtcctgcattacggaacttagatgccactgcttgtttgacagctagttcaagattggcatctttgtctacgatgagcggggcatgaccgccaagctccattgatacgtgcttgactgtacttgcactgtttttgatcaaatgctttccgactggcgttgagcctgtgaacgtgattttgcgaatcaatgggctatctgtgaaaatttcaccgacttcttttccatctccaaccacccattgcaaggcatcctctggaattccggcttcgtggcctaatttcacaagttcaatagccgtcagcggcgtgtcttcagcaggtttcacaataaaggtacagcccgccgcaagtgctggtgctgcctttctcgtgatcatggctgcggggaaattccacggtgtaatggccgcaacaggacccactggctgttttgtgacaaaaaggcgcttgttcgccgtatgggaaggaatggttctgccatagattcgtttggcttcctctgcgtaccattcaatatatccagccgcataaacgatttctcctaatgcttcttgatacggcttcccgttttcttcagtgatgatttttgcgagcctttctttatgttcaatcatgagatcaaaccacttgcgaatgatattggcacgttcatgtgctgacgtttttgcccatgttttgaatgctttatgtgagcgagtgatcgcatcttcaatctgttcttttgtatgctgagcaactgaagcaatttcttctcctgttgcaggattatacactttgagttcgtttgtcatgctctaccgtctccttcgttcttggattcattacatatagtatatacccaatgagtgcccaacctaaaagcaatatccattcagctggccatgataaggaggccggcatccctggaaaataaaatgaaagaaaaaggagactcagcccgatggctaaaacgcctgtcgtccgccaatatttaatgcggtatggacgctcaagttctggttctgctttgcgaagtttcacaaaggcaatggacacaattaagtagccgacgatgatcccgacaccgcctgcattgacaatccacacgagggcagggcgccctaataatggagcgaaaaaggccaaagcaccaagaaataaaatggcatttgtcggcgttttatactttggatgaatatacgcaaaccatttggaaatcatgcctctttccgccatcgcgtatagaatacggcttgcaccgatgataaaagcattccagctcgttacaatccctgctacaccgccaatgacaagcactgtcccaaatgcttgatgaccaagtagctgtaccatcgcatctgctgtcgccaaagaagaggcttcaagctgtccttttgacagccccgcagctactccaaagacaataagcagataaaatacgaccgcactcacgatagagataattaaaattctcccaatgattttctttggcgcattgatctccgccgccacttgaggaatgacatcaaagccaacgaataaaaagggaatcatcactaaaactgccatgagaccgccaaccccgccttgaaacatcggctcaaggtttgctagatttccgttaaatgtggcgccgcctaaaagaagaaaacctgtcaggataatggccactgtaaaaacagattgaaaaatagcggctggcttggcaccaatgtagttaagcgctgttaaaaataaagcaccgccagatccaatcaacacccatgtaaaataaacgtcccatccccctatattccatagaaagccaacatgttgtgttggaatgacataatcaataacagttggcagtgcgactgcttcaaacgtaatgaccgaaacatagccaaacaacacgccccatgccgagacaaaagcggattttatcccaaatgcccgctggacaaagacgagccctcctcccgtctctggaatcgcagacgaaagttcagcatacgtcagtccaataaagatgacgagaataccacctataacgaaggcaatcacactgcctaaaaatccagctgttaaaatccaatctcccgaaagtacaacccagccccatccaagcattgcaccaatggataaaaacagtacgtcagactgtgacatggtttttgccatttgttgtttttgcatacaaccatccccctttgttgtttagcgtgctttgaaggcgtcctcgatgatccctagtccttcatgaagcagctcatctgtgatgacaagtggtgttaagaagcgaataatattcccattaatccctgccgttaataagagcagtccgtgctcgtttgcatatgatgcaatcgctgcggctgttttcttatctggtgtacgcgtagtttgatcttctacaatttcaattgccgccattgcccctaaccggcggacttccccaatgaatggatacgccactctccaatcatttgctttctcctcaatgacttgtccaatgtgttcagatcgttgattcagttgttctgtttcaataatatcaagaaccgctagcgctgccacacagcctaatggacttcctgcatatgttcctcctagctcccctggatctgccgcatcaagcagttcttttctgccgacaacaccgcttagcggcaacccagcagcaagagattttgacacagtgattaagtccggcaccacatcaaagtgctcaatggcaaaatatttacctgttcttgcaaagcctgtttggatttcatctgcaacaaacacaatcccgtgctcctgacagaatgaagctacatgctgaacaaaacgcttcgatggtacaatgaacccgccctccccttggactggctccatgaccacacacgcaacggtttctggtgcaacagcagcgacgaagaattgattgaattgatcaatgatgtactcatcgtaggctgcatcgcttaatccttctggtttctgatagtaatacgggtatggcgcttgatacacctctgacgcaaatggtccgaacccaaatttatatggcttgaccttactcgtcatgctcatcgtcatattcgttctgccgtggaagcctcttgtaaacgagaccacggcctgtcttttcgtatatttacgtgcaattttcaccgcattttcaacagcttctgcacctgaattaaggaaaatggctttcttgtcatggtcacctggtgtaaggcggcatagcttctctgccaattcgatatacgattcgtacatcatcacattgaatcccgggtgaatcaggctgtctgcttgtgctttgacggcttccacaacctttggatgtgaatggcctacatttaacgtaccgatcgcgccagcaaaatcgataaaacgtttcccatcgatatcgaacagctcggcacctttcccctttgctgcaagatgacggttgccattactcacgcctcttgcgacgtattgatctcttttcccctgccattcctcagttgaaaaacggtttgttgtcgtttgactcattgtcatccatcccctttatgtcttttttattattctgaatattttttggtatgatagaaagtaccaatatcatttttttcatggtaccagagaggaaggaatgacaagatgctgacaattcaactagatcaaacaggggcaaacggatttatttatcatcaaatttactcgaaaattaaaggtgaaattttaaatcgaaaccttcagccgcacgatcaattaccgtccaaacgagagttagccgatacattaaatgtcagcgtcaattcagtgaatggcgcatatcagcagctgcttgccgagggatatttatattcggttgaacgcaaaggttttttcgtggaatcactcgaaacgtttcatgaatcaggtcagctgaaaccctctactctcccagcagatttaaaggaagagccgattgcacgagacgattggtattccttttcacatatctctgttgatacagccaattttccgtttaaaagctggctgaaaagtgaacaaaaggcgatcagtctccaccaagaagcatttggtgagcttccgcatccacaaggcgtgtacgagcttcgggaaacaattgcccggttaatcgggcttgcacggggagtcaaatgctatccagaacagctcattttaagtgcaggcacgcagtcacttatccattcgctatcaagcattcttccagccgatcaagtatacgggttagaaaaccctggctatcgccggctctatcaaatgctaaaaaacaatcatcaccaaattgaaacgattggcattgatcaaaaaggagtacggatgagtgacattcagaagaaagagccgaatgtgttgatcattaccccttcacatcaattccctacaggggtgattatgccaatttcccggcggattcagctcttaaactgggcagccgatgagcaagaccgttatatcattgaggatgattatgacagtgaattcaagtatgggactgacagcattccagcgctgcaaagtttggatcgatatgacaaagtcatttatatggggaccttttcaaaatcattgctgccaggcttaaggctaagctacatggtactcccgcagcatttattgagacgctataaggaagaacaacacttcttcattcaaacagccaacctctttacacaatacacccttcttcattttataaaagatggagcatatcaacggcatattaaaagaatgaatggtttatatgaggaaaaacggaagcagctcattggagagctcaatacggtttttgctgacaatgtgcggattattggggaaaatgctggacttcattttatcgcagagttccgttcaaaccgcacgcagcatgagattttacagcgtgccaaagaaagaaagctgaaaatgtatgggatggaccgttttacccttgatgagcaattaccggggcatcaggaaggctttgttccactcgttcttggcttctctcatatgcggccagaggatatagagccagcggtaagaagactgtatgactcgatttatggaaaataaaacagccagctgcttttctagacagctggcttaccaccgctctttatctacggttaaaatggatgatacgagtccaggaaaagcggtctcaatgtcttcttttcttaaagaataatagcggtgttttccgtcaattctcactttcacgatgcctgcctccctcaacactttgaagtgatgtgacagcgtggatttggcaatattcatctcatacgtgccgcatgtcctctcgcctgcttcagctaagcagcggacaatttctaaccggattggatcggccaatgcgtgcagcaccgaaatcagtctcatgtcttcttgggttggatggattggattattcatacgataaatgtatcgtatttcgtgccaacatacaatctccttacccgcctcacaaagtaacgatacatccttcggaaacgactatgactatataataactttcttgtgaaggggaggatctcatttgacacgaaaatgttggacttacttatgtttaatgttactcaccatttgcttatgtggatgccaatccgtccggtatgccgaatctaaaccacctagtgcagaagaggtattagctctcgatgaacaggcagatttatttcaatgggaagaaacggtctatgaagcaaatgtagattgggcccatcaactaaccgtcactaaagatcagcaagtaggtgtgattcagaaaacagctgccgaacattttaatcacggcacagcttccaagttgaaaaaagggacagcgatttactctgtaaaggaacgagaagaccttttaatcgccgaacttaacggacagatcatcatatatgccgcacatgcggaaggataaaatacctgtcatcagataggtgtttttttaagtttcttttcttgtcataggtcattggttttgttatcatagcaaaagtgaccactcggtttccattgtgaccatatggttttgccgattcggaaaggacttatgaagatgaacgaaaagcaagaagagattttgcgggtttcaaagaaattattttctcaaaaaggctatatgagtgtctccatgcagtcaattgccgatgcctgtaaaatatcaaaagcgtctatttataaactgtttgattcaaaagaagctcttctattagaactgattaaatacaatcagtgcaaaatgagagagatttctcaaatcattcattcagaaacgacgctgtccaaaaaggaaaaattcacaaagaagatcaagcttgagcttgaagagtttaaagagaatcataaatttttgaatatgctgtcctttgaagctttttcacagcattcgcccattgtcattaagcatttacgtgagacacgctccattatcatgcagcggcacagagacattattttaagcacatatggtgattctgttgcgccttacgtctgggatcttgtcattgtcctcaacggattaatgagagaattcattttaatgctggcgattgagcgcaagaacatccaattagaaaatgccgccgaaatgattatcggcgtgatggaccgtgtgtcgaaaaagccttgctctattgagcctgtgctaacagatcagctgatggactcttatttgctttccacacaggacgaatacgatgaagaaaagcttgtcatctcgtacttaacgaagatcaaacaagagcttcacacactgtcaaacggtgaagaaaaggacgatttcctctctgcgtttgaactgctaagtgaagaattatcaaaggaccaaccgagaacctttttaattagttcactactcgattatttaggaaaaaacagcgttttatcacaaaacgtgtcacagctgaaaagcatcatcttatagataaagaagggataacatgaaccaatctacaacatcgtataatcgatctgtgattgtggggattttcctcgttggggcatttgtcgcaattttaaaccaaacattgctcattccagcgatcccacatatcatggaggaattcaatattgatgtcagcaaagggcagtggctcaccacagcctttatgctgacaaacgggattctcatcccgatcacggctttcttaatcgagaaattttcaagccgttctttagttttaacggcgcttagcatctttacagccggtacaattcttgcttcatttgcaacgaatttccctgtattacttgcagcgcgtattgtgcaggcagccggtgcagggattttaatgccgctgatgcaaacgatctttttaaccattttcccgaaagaaaaacgcgggcaggcaatgggcatggtcggacttgtcatatctttcgcaccagctcttgggccgacacttggcggctggattgttgattccttcagctggaagttcctgttctatattgttcttcctataggtattattgatcttattcttgctttcttcttaatgaaaaatgtaacgcagcaaagagagacacgtattgatgttttatctgtcatcttgtcttccttcggtttcggcggactgctttacggattttctagtgttggcacatacggctggacaagtgccactgtcctcatttcgctgattgtcggcgctgtgagcttgttcttctttattctgcgccagtcgaatttgacaagaccgatgcttgaatttggtgtctttaagtttgcaatctttagcttgacgacatttcttgggatgcttgtctttgctttattgattgggacagagacgattctgccgctctatacgcagaatgtgagagggttgtctgctcttgatacaggactgatcttattgccaggtgctctctttatggggctcctctcaccaattattggacggatttttgataaagtcggcggaaaagggctggcattaggcgggtttacgatacttaccgtgacgaccttgccatttatgctgctcacccttgattcatccatcgccctcattacggtcgcgtacacgcttcgcttaatcggggttgggatgatcatgatgccgctgacaacagcaggtattaactctttaccacctcatttgatcccgcatgggacagcgatgaataacacgatgagacaaatgggcggttccattgggacagcagtgcttgtctccatcatgagcagctctgctgcaaatgcagaattggccagcccattaaaatcagccgttcatggaatgaatacgtcattcttcatttctggtctgattgcggtcattgggcttgtcctctcctttttcttaaaggaaaaacgcaataataaagtgatgaagcaggagctatcttcctcctcatcttcttcataagaaaaagagctcggcatatggccggctcttttttcatatactcacgctataccgtcctccctgaaaatacatttgtatttctagtgaagaaaaaccttgataatttgaagaaaagagttgataataggaactattcaatttgtgagaaaatttttactataggagatgtatgcattgaaggtcgttaaatttggtggcagttcacttgcttctggcaagcagctgcaaaaggtatttgacattgtaacagcagatccagctcgaaaagcagtcgttgtttccgcaccaggaaaacggcattcaacggatacgaaggtcaccgatctattaattagctgtggtgagcaatatttacgcttaggtgaagcacacgatttacaggaagccgtcattgaacggtatgcctccattgcggatgaactcggattaagtcatgacgtgattgacaccatccggcaagatctagatgccctcttacaggctgatacgtctcatcctgagcgatatcttgatgccatcaaagcaagcggtgaagacaataacgcaaaactcattgccgcctatttccgctatcaaggtgtcgaagctcactatgtgaacccaaaggaagctggtttatttgtgagcgatgagcctggtcaagcgcaagtcctatcggagtcatatgatcatttgtataaattaagagagcgctctggtatcatcatattccctggcttttttggctttagtctatcgggggacattgtcaccttttctcgcagcggctccgatattaccggttccattttggcaaacggtttgaaggcagatgtgtacgagaactttacagatgtggatgctgtttatactgtcaatccaacgatcgttcatgagccaaaggagattacagagcttacgtaccgggaaatgcgcgaactttcctatgctggtttttctgtgttccatgatgaagcactcattccggccttccgtgcaggcattccagtacagattaaaaacaccaataatccttcggcaaaaggcaccaaaattgtgaaccagcgggatcatactaatggacctgttgtcggaatcgcttcagacagcggattttgcagcatttatattagtaaatatttgatgaaccgagaagtcggttttggacgcaaagtgctacaaacgttagaggaatatgggcttacgtatgagcacgtcccttctggcattgatgatatgaacattattttaaggcaggatcagctggaggagcagcatattgaacaagagctgctcgaccgcttgaaggatgtgcttgatgcagatgaggtcgtgttagaaccgcatctctccctcattatggttgtaggagaagcgatgcgccacaatgttggcaccacagcaagagcagcaaaagcgctgtcaaaagcgaaggtcaatattgaaatgatcaatcaaggatcttcagaggtcagcatgatgtttggcgtcaaagcggctcaagaaaaagaagccgttcaagcgttgtatgaggaatttttctctatgtctaccgtccctgtctctctttaatcagcaggctgtcagatctcaggatcggcagtcttttttgttctcacccgattcacatggatttacgcattaaagtgtatctatttctcgtttgattttgtatgatagagacaaaccaactattgttccggcctatgagcggagctacaaggagtcctaaaacaatgcctcgtcaacaactattaaaacagtttcgcaactttcatgatgcttctacgagtattctaaatatgatgagtcaattcactgatgtgaatacactgtttattgctaaaaacgatcaaaccaccaatcagattgtaaaggtgttaaatcatgacgagcagcttcttgaagaaggggaagaaattccttacgagaagacattttgcaagctggcggtcgatcatcacgatacgcttgtgatccctgatatatcattggatgatcgttctaaatccttagaagtcacgaaacgtcttcaaggcggatcattcatcggagtgccgattgattttacagatggtacgaactacggaacgatttgcgggcttgatctaaggccgcagcaattcacagaagagcatgtgcatatgtttgaaacgatggcttctctattaagctacgtccttgaactagaccgtgccaaccggcagattcagcaattatctgtaccgatcgtcccagttgttgacggtgtcgccgtgcttcctctacttggtgatatcgaagagacacgtgctcagcatatattagaaaccattttacaggaaagctacaggctgtcgctctctcatttggtcattgatgtatcaggaacaaaacgcctgaatgaacagagcattcaatatctggtcaactatgcacaaacgctgagacttttagggatttctgctgttttaacagggattaagcaagatcttgctttaagtgcgattcaatcgaatatatcatttaaagacatcaccattaggaaagacttgccgcaggcacttgctcatattggcttaacatttaccaaaacggaataagaaatgatagacacaaaaagggctaaatcaattttagcccttttcttctttttaaatcatgccaacagctgcaaataagaagaatcgtttccgtcttcaataacttgtacaatcttctgtgcatgtgatgcgtctgtgacactgtttaatttttgcatgatgtcttctttcgataatgcatgacctggtgcgcctcgcggaatatcgactcgtttgctaatgatggtgccatcagataaggtgagcttcacaatcgtaaagcgaccttttgggacagcgtctggatggggttctatcgtttgatcatattctctcttcacccgtttcatccaagtgcacatgtttgatggaatgtgttttttcgtaaagacatccagcgtcagcgactgtccaaacgcggcaagtgcgatcacgtattcgacactaaatcgtccttcttctccagtcgaaggtgtccgctcaataagcgctgcatctccgccaggcgggaacaggacatctacttgtttcacctgttctggcaagaaagcccgctctttcattaaggattggatcgcatctgctgcatggtgggcagctgagcagaatggatatactttgaaccacagccctggtgaaacgatacgccatgtagaaccatagccctctagtaaacgactttccgcaagttccagatctccgtagagtgaaaagaaaccaagtgcgccatcaagaaccgagtcattgccaccaaaacctgaacaagctaagtccatagaccagacggctgttttagccgctaagccagcttgtaatggtttcatatcagagccgaactgctttcgcattccggcagattgcgctccagcaaagccgattgccttcatcagctcttcctgcgagacttgttttaaatatccaatggcacatactgccgcaatggctccaagggttccggtattatgccagccccgctcataatgcgcttttccgatggattcaccaagccttgccatcacttcaacacctgtgatgtaggctgctaaaaatcgatcgccaaaccctttgccgtctgatagctgtgaaagcaaggctggaatgatgactgcacttgggtgtcctctcacgtctgaatgcacatcatcataatcaagggcgtggatcaagtagccgttcagcatcgctgcggattgacggctgaccttcttcccttgtccgatgacaggaatttgagctgctccgccttcttgttccacaagtgccatgagcttttgaattccttcgtcctctttcgcagcaagcgctgctgccgcagcgtctaacagaccatttcgagccatttctaccgcccgctgatcttgaagtggatcagcagacagtacagcctctgccaattgttttgttaattccatgatcgtgactccaatgcccgaacagcaagctcggcaaagtaggcagctgcaactggaagtgcgtcttcatttaatgtaaaggcagggtgatgccattcctcggtaccgcttgtccccatccatacgaaaaagcctggaatgcgttcttgataaagggcaaaatcttctccgcccggtgactgctctgcttgaacgactgtgagattcagcgcacctgccgtttcttcgaccacctttgtcaaacgatcgtcattcaacacagaaggcagatatggatgccatttcacttcgccttttgccccaaacccttcggcaatcccgctcacgatttgtttcatgagctcgggaatcatcgctctcacttcaggctcaaacgtccgaacagttccttccatctcaacacgatcaggaatcacattccatgatgtaccgccttgaatacgtgtaatgctgacgactgcatgatgcaaagagctgatgcggcggctgacgatttgctgaagagcacttgtgatctgcccactgatggcaatcgggtctaccgtgtgattcggaatacctgcatgaccacccgttcctttaatattgatttcaaaccggtctacacttgccatcaatgctttttctctaatgcctatagtgccaactttcaggtctggtttgttgtgcataccaaaaatggcatccactccatctaaaacgcctgcctctatgacatgtttcgctccttgcgcgacttcctcagccggctggaacaaaatgcggaccgttcctttgagctcgtgttttcgttcttttaataaaagagctgctccaaagatagaagctgtatggaaatcatgaccgcaagcatgcatttttcccggtacctttgaggaaaatggttcgccagatgcttcttcaatcggaagtgcatcaatatcagctctcagggcaatcgttggtccctcttgttctcctttgatttcacagacaacacctgtttgaagagctggaaaatcgagtacggtgatcccctcctcctctaaccagcggcgcagtttttttgtcgtttcatattcttcaaacgccagctctggatgctcatgaagcgctcggcgaatgttaattaaacgtttgtttaatgcttcatttcctaatgatttcactgatactcacccctctaaagagtaaaaagcagcttatgcttcttcagccgctgcttctttttggataaatcgttttgtccgttcattcttcgtttcatcaaatagctcagttggtgtgccctgttcaataatatgaccatccgccatgaaaatcacatggtctgccacttctctagcaaacgccatttcatgtgtgacaatgatcatcgttgtttcttggatcgcaatggacttaatgacttgaagcacacctgagacaagctctggatcaagtgctgacgttggttcatcgagtaaaatcgcatgtggatcaaccgctaatgcgcgggcaatcccgattcgctgctgctgtccgccagataacgtgactggatagctgtcagctttttgctctaatcctacttgcttcagcagcttcattccaatctcatttgcctgctgcttcgtcatttttttcgtcacaagcagtgattctgtgatattttgcagtgctgtcttgtttttaaacagattgtagttttgaaacaccatggccgtttgttgacgcaggtgatgggcttcttttcgtgtatatttagacgcatcgagcttcgcatcgccaatttcaatcgtgccttcatctggtatttctaataaatttaagcagcgcagcaaggtggatttaccggagccagaaggtccgataatggccacaacctgccctttttgcacatcgagattgattccgtctaagacgacaaggtcgccgaatgatttcttcaaattggtgagcttgatcatgtccacacctccttaattccggtaaggtttgctaatttttcgttcgaataggtcttgaaggaagctataaatgatggtcatcacccaatacacaatccctacggctaaataggtttcaaagtatttatagttcgccgacgcaatcatcttcccttgtgcaaacatttctgccacaccaatcgtaaaggcaagagatgtttcttttaaaagaccgataaaggtattccccgtcgctggaatcgcgtttcgaattgcctgcgggaaaataattctgacgtaagactgccatcttgtcatgccgacagatagacaagcttccagctgcccttcatctacagagttgagggcagctctgaaaatttctgctaagtatgctgagtttttaatacttaatccgataatgaccgctgttagagcatccattgaggtcatcgcagggaatagctgcggaagaccaaaataaatgagaaagagctgaaccaaggttggaaccgctctgaaaaaagaaatatacagcttggcaaattggtacaaaacaggtatccggtttttcgtaatgagagcgaataccacaccaatgataatggcaaataccatggagacaatcgccatgaagatcgttatcggcaagtattggatcaatgtcggaaaaacggtcaccatatactgccaatcaattttgttcatgtctgctcttcaccgccgctgtcgttattttttaattggcaccgtgacatcatctttgaaatacttctcagacaatttcttcagtgtcccgtcttctcttaattctttgattgctttgttaaattcttctcttagcttgtcatgctttgtatctttggcaaatgggtagcctacttcttcatacacaattgggttgccgacgattttgagcggcagacctgttttttcaatttgagcaagtaatacactgcgtccgttgacataagcatctacgcggccatttgccacttcatttaagacaccatcttgcgtttcatatgttttaatattgatttttttgtccggatctttgctctctaagtttttggcatggttagagccaagaactgccgccactgtttttccttttaaatcatcaagacctttgatgtcattgttgtcctttttcacgatgatttgtgttcctgcatatgcgtacgtatcagtaaagttaaacgtttgtttacgctcatctgtgactgcgacttggtttgacactgtatccagcttaccagatgtcagctgccccattagtccgctgaattcactcagctgccagtctagtttgtagcctagcttttttgcaatagcttcagttacttcaacatcgaagccaacaagcttgccattgtctttataagcaaacggatagctttgccctgtggcacctacttttaacactttttcgtctttgccttcactctgattgcctccgccgcaagctgctaaaactgccagcattgctgcaaatagaacgactagccactttttgtttttcatgttcgtatacccttctttcctcttatggttgtgtaatatctgaccttagttgttttttcaaataaaccgtgatgtgtcccttgcctaaatccttttctcctgctctgacgtagcctttgcgctcatacatgtctatgagccacggatgcttatcagctgtacctagagatacgtatggcacctttaaggtatcccttaggacttcggtttccacccactccagcaagacagagcctgtccctttttgggcggatggttctgaggcaaaccaccaaatgtgagggacgccgaacgggcctggctgttctccccaaggcatacggagcgacaaggtggatagaagctctccgttttcttccatcacatagcagagattcttttgtacatttttctgaacgagagcaaaatcagcatgtgctgcttggaactggatgccgagctcacgaattggctcataggctcttgttgtcagttcaagcagtgcctctatatctgcctctgttgccagacgaaacgtgtatcccaacgttagtcacctcacctttatgtcgtgtagcgattttttggctcagttaatccaagattttctcgcaaggtttttcctgtgtattctgttttgaataagcctctctcctgaaggattgggacgacgcggtctacgaacatgtccagcccttctggcaatagcggaggcatgacgttaaagccgtctgccgcttcttcattgatccaagtttccatcacatctgcgagctgctgcggtgtgccaatgaaaatattatgaccacgagagccggcaaccgattgatagagctggcgaatggtcaggttatcctttctcgccatattcatcacgagatcaaaacggctttttaccgcattggacgcgcttggatcaatctctggaagcggaccatctaaaggatactgagacaaatcaatcccacctaagtagttttgcaaaatgctcagcccaatctcaggaacaatcagctcctgtaattcttcatatttcgctttggcttcttcctctgtatcagcaataatcgggaagatccccggcatgatgctgacgtcctctctagcacgaccagcaccctctactttctcctttaagctttgataaaattccttcgcttttttgagatcgttttgtgctgtgaaaatgagttcagctgttttcgctgcaagcttttgaccatcttcggatgatcctgcttgaatgatcactggctgcccttgaggcgtgcgtgatacgttgagaggacctcgtactgagaagaactcccctttatgctggagctcatgcagcttactagattcgaagaattctcccgtttccttgtttctgacaagggcgtcttcttcccaagaatcccaaagacctttgacgacttcaacgaactcttctgctcgctcgtatcgtttatggtgtgctaaatgctcttctccgctaaagtttttcgctgtttcttcaatagaagatgtgaccacattccatgccgctcttccgcctgataaatgatcaagggaagcaaactgtcttgcaatatggaaaggctcactgtatgtagtggatgctgttgctgctaaaccaattgatgaagtagactcagcaatggacgaaagcagggtgagcggttcaaatctcgtgagtacattcggatgagaggtttggttaatggataagctgtcagctaaaaagagtaaatccagctttccttcctctgcttttttcgctaattgtttaaaataatccaggttcatggctgcatctgatacggcgttcggatgtctccaagaggcaacatgatgtccagttcctgcgatgaatacgcctagcttgagcttcctttttggctgtgacacttgttcttcatcctttctatatcctgctgtatcaaactgaagtcctcagaagatacatttttctgattgaattaatcggttttatcaataaaaaaagggcaaatgttgcgaaaaatgaaaaataattattactatatgccctttttacaggattgtcaaccgccttctgaacctccaaaattagggattttactcattcatcacggtgtatcgatttcaatatttccgatgagccggtctgtagtatgtgtcaccatttgactgcgttccagcatgttatgggcgatcacggaatgagtggagtttgcggtgcggatggcaatcgctttttgaggtgatacattgatgatgttattgcgcagcacacgggctgaggcagcctggtcaataaagatcgctgtcggttgtccgaatgaacgatttaaataaaagcggttatctccgatttgtggtgaaccgtttttaatatacatcacgacatataaagatgattcttcaaaggaattgtctttgatttctaatggccccgtcgtgctgctgtatacggcgtagttttggtagtgcttaaaacgattatgccaaatgaaagcctttgcatttccagtgacactgatcgtatacgaagacccaagctctggatgtccttcttgaataaagtgattgccgttgatcccagcttccccttcctgcacccagatccctctactgaattctttgaattgattgtgctggatcaggatattcgttcctctcaccatcgccccatcgatcaccgaataaatggtattgttcgaaaagacgacgctatccgattgatagatacgcagtgctgcgcttctttgccctgtattcgtccccgattcaatatgatttccttctattagaatacgattcgccatataaacggacaaagccgcatcttcaaacagactgatcttattccctgtaatgtgaacactgtcgcccctcacatcaatccctttttcaaacccttcaatcatattgccaataataatcacattgttttccgtttgaccaagagagatacctaagctcgtaattcctgcttttgtgacgcctcctcctactgcacggatcaaattgttggcaatgattgtttccgtggcaaagccataggagatgctgctatctgtatgattgccttcgatgatgacaccatagccattgaagttataaatggagcttgcggcgccacctctcacaatgttgtttcgaatttgaatattcagcggttcctccatattcactgcattttccccgtagccttcaatatcaatgcccattcttggctcgactccgtttactcctgctctctccagcagacagtcctctacaatgaccccatcacagcctgtgatcgagatattgtttcgtcttgaatctgtaatgtgacaaccagcaatatggatcgacaaagcaggcgagtacgattcagcttgtgataataaaccgtggggactgacaatgatgccgtctcccgtacaatttttgatttgcacacgattcacatctacatcagatgccccttcaatacatatcccaaaaccccactcatgggtttttcgttcagggggaagcgatttatacacatgctcatgacgatccccttcgattcgcccgccccggatggtgacatgctgaacctttcctatataaaaggccgcatacccccacgaatcatttggtttcaccttaatgacggcatcctgtgccatctcaatggttatatgacttggcacacgtatacccgcaccccggaaaggaaaaaattgatctcctctgtacactgcatcgatgacatacgtgccgctcggcagccagacgtgggaatacccctgtgctttcgtccattctaagcattcattgagcttcgctgtacagtccgttttcccatccgccactacaccaaaatcttgtacattgacaacaggcttttttagatcagattcattcaattcccccaacctaaacccctccttttcacacatgtcctcttgtcatcctatgcatgtgtaaaaggtttgcttgtacaatccttcaaattttaaataaattctttcgatataactttctgaccattctcacttgagagaatttttcatatttttgagactttacgcctattgaactaacattttcctgttttagaatagttttatattgacacaagaactatacaagaatatcatttttctcatatctctttttttaagaaaggatctatgccatgtctacaattgaccacgataaaattgttaaaagtgttcctcaaaaagggttttttggacatcctaaaggactttacacactgtttttcactgaattttgggagcgtttctcctattacggcatgcgtgcactgcttatttattatatgtacacagaggtgacaaaaggcggtcttggttttgatcagacgacagccaattcgatcatgtctgtctacggtgcgcttgtctatatgtcaggcattattggaggatggctcgccgaccgggtattcggttcgtctagtacggtcttttatggcggggtgttcattatgcttggacatgtcattttggctttgccaagcggagcaacagcgctctttataagtatgggactgattattattgggacaggccttctgaagccgaacgtttcaaacattgtgggcgacctgtattccaaaacagacccacgcagggattctggctttagtattttctacatggggatcaacatgggcggttttattgccccattaattgtcggaacactcggtcaaaaagtgaacttccacctcggattctcacttgctgccgttgggatgcttattggtctgattacatttgtgatcacgaaaaaaccgaaccttggtcttgccggtacttatgtgacaaatccgttatcagctgctgaacgcaagaacttcaaaattttcggaacattaattgctattgtactcgctgtttttgtcgtcattggcattcaaacaggcgcactcacgattaatctattcacttggtttgtcagtgttcttggggtgctcattccgattgtctatttcatcgtcatgtatttcagtaaaaagacgagcccagtggagcaatccagggtcctcgcttatattccattgttccttgctgccgtgatgttctgggcaattcaagaacaaggctcaaacattttagccacatatgcagatcaacgaacaaacttgaatttccttgggatgacacttgcctcttcgtggttccaatcattgaaccccatctttattgtgctattgtctcctgtatttgcttggttgtggatcagacttggaaagaaacagccgtctaccccgattaagttttcacttggccttctgtttgcaggattatcctttatcatcatgatcattcctgcctacatgtctggtccaaatacacttgtgagtccattatggctcgttctgagcttcttccttgtcgtgatcggagagctctgcttatcaccagttgggctgtcagcaacaacaaagcttgcacctgctgctttctcagcacaaacaatgagcctttggttcctttcaaatgcgatggcacaggcgatcaacgcgcaagtggtcaaactgtttgataaagtgccagaaaccgtttatttcggtatcattgggttgctcgccatcgttttatgcggtgtaatgctgctcttaacaccagtgattaagaaagcgatgaaaggtattcattaaataaaaaaagaagcctccccattgggttggcttcttttttctagtttaaaaccgtatctcatcatctccatgaatttgcagcttaagcggttcacttttcgcctgatgctttttcacatagcggtgatagacaacatacccaatgatcatgagagggacgccgacatataatccgatgcgctgttcttgatcaaaggcaaggctgaccaaaacaatggtattcagcgtgatcgcaacaatcggcagcaccggatagagaggggttttaaattttaagttttccagctttccgcctgctttaagatatcttctgcggaaaagcatctgtgataaggtaatggtgatccagccagtctgggcactcataccggcaatggacacgatccaagcaaataccgttttctctgcaaagaacccggataatagcgaaattcctgtaaacaggaacgtgagcagtaaggcattcatcggaataccacgctgattcacgcgtctgaatgcttttcctgccattccttctttcgataaggaataaagcattctcgtcgatgcatacaagccagagttggcaacagataataaagcgatgataatgacaaagttcatgatatctgccgcaaaaggaatgcccgttctctcaaatacagtaacaaacggactttgcagcacactcgcttccttccaaggcaccatacctgctaagacgaagatagataggacgaaaaagacaagtgtacgccaaacagtctgatgaatcgaacggggaacggttttttcaggattttcactttctcctgccgcaatcccgatcagctctgttccttggaatgaaaagttcacagtgatcatcgtgaccaccacggcgagcaatccatttggaaacagcccatcactcacaaaatgactgaagtaaggggcaggttcaccgctcgttgtttcaataaaaccaaacatcgccgcgccgcctacacctataaagagtaaaatcgcaataattttaatggttgaaaagaaaaactccgactccccgaacgctttcgccgaccgggcatttaataagaaaagacacagtccaaatatgagacaccaaatccacacatccacttgaggaagccagcgcctcatcagctgtcctgctgataaaaattctagggcgaccgttgctgcccagccaagccaataaatccagccaactgcaaaacccgctgcagggctgacaaatttcgtcgcatacgtatgaaacgacccggacacaggtagtgcgaccgacagctctccaagacacagcatggttaaatacataatcaatccgcccacaatataagaaagaacggctccaactggccctgcttgtccaatcgtatagcccgttcctaagaaaaagcctgtccctatgacaccgccaagtgaaatcataaataaatgacgggaggtcatcgcccttttcaattgctcaggctgattttgtccaacatccacaatgatgccctccttcttctaagatgttcttttatcaaaacatgtctccatgcgattcatttcattttcaaaacaacctactaattatacatcttttataataaatatgcttccttctatggtcactgtctcaaagtctttattttagtaatgttcgcacaaataaaagatgaaaggctttgtagacgtgagaggtttgaaagaaatgggcagcgggcataaagttggtgagattcgctcaagctagtttcaaatgctttacttttaggttgcttctctgtaagatcatatgttgtaaataccaacaagaaaagtggggaataaaatgaaaaaaatgttctttgccattatgttaggcgtttgtgttgcattgatcactgcatgtggatctggtgcaagcgacaacgcgaataaacaaactgggtctaaggaatcaggcgacctttggaaatccattcaggataaaggtgttctgacgatcggaacagagggtacttatgctcctttcacattccatgacaaaaagacagataaattaactggctacgatgtagaagtcatcacagaagtagcaaaacgtcttgacttaaaacctgaattcaaagaaacacaatgggacagcatgtttgctggactgaattcaaaacgttttgacgtggtagcgaaccaagttggtaaaactggacgtgaaaatcaatacgagttctctgataaatacacaacgtctcaagccattgttgtgacaaaatcagataacaacgacatcaagaaactatctgatgtaaaaggcaaaaaagcagcacaatcattaacaagtaactacaataaactagcaacagatgctggtgctaaaattgaaggcgttgaaggtcttgcacaatcgattcaattgatccagcaaggacgtgctgatctgacattcaatgacaagctggctgtattgaattacttgaaaacaagcgggaacaaaaacctaaaagttgcatttgaaacaggagatcctcaagaaacttactttgcattcagaaaaggcagcggcgaagtcgttgacaaagtgaatggcgcattaaaagaaatgaaaaaagacggtacacttgctaagatttctaagaaatggtttggtgaagatgttacaaagtaataccctaggagtcgtcattccttgggatcttcttcagcaatctttttggccaatggtgatgcaggggatttattatacaatccccctcgccatcattgcctttattattggtatttttatcgcgcttgtgacagctcttgctagaatgtctaaaatcaaagccctcagatggattttttccatctatgtgtcggccgttcgcggaacgccgctttttgtgcaattgtttattattttctatttctttccgacatttaatatcacactggatccatatccaagtgccattatcgctttttcattaaacgtaggtgcgtatgcgtcggagattatccgtgcatccgtcctgtctgttcctaaaggacaatgggaagctggttattccatcgggatgacgcatcgtaaaacactcgtccgcgtgattttaccgcaggctgtgcgtgtatcgattcctccgctatctaattcattcattagcttggtgaaggatacatcccttgcctcccaaatcctcgtggcagagcttttccgtaaatctcaggaaattgctgcagccaacttggatcagatcttgttcatttatatggaagcagccctaatctattgggtattctgcttcattctatcgctcgttcagcatcaaattgaaaaacgacttgatcgatatgtcgcaaggtaaggagggaacgacatgctaacagtcaaaggtcttaagaaatcctttggggaaaatgagattttaaagtcgattgatttttcgatcaacaaaggacaggttgtggccattctcggtccatctggttcaggaaaaacaacaatgcttcgctgtttaaatgcacttgaaacaccaaatggcggctccttcaccttcgatgatttctcaattgatttttcgaaaaaaaataaatcagctgatctgctcaagcttcgccggaaatcgggaatggtgtttcaggattatcacctgtttccacaccgcacagtgcttgaaaatgtgatggaaggtcctgttcaggtgcagcgccgtccaaaggaaacggttcgaaaagaagccattcagctcttgcaaaaggtcggtcttgaagataaaaaagacctgtatccattccagctgtcaggcggtcaaaagcagcgtgtcgggattgcccgtgcacttgccattcagccagagcttatgctttttgatgaacccacctctgcgcttgaccctgaacttgtcggagaagtcttaaaggttatgaaggatctagcgaaggaaggctggaccatggcggttgtcacacatgaaatcaagtttgcccaagaagtagcagacgaagtgatttttattgatggcggcgtcatcgtcgaacaaggtcctccagaggaaatcttcaaacgaccaaaggaagaacgaacaaaacaattcttaaaccggattttgaatccagtatgatgaaaaaaggctgttctcacgtggtgagaacagcctttttttatatttccttttgcaagcgaagcgccagtaaatcttgtaagagcaatctcgctccctctggactgataaccactccgcccgatagcactttgttggagtttgtcacttcccctgtgacaatacagggtttgtcctgccaatatggcttaatgacaatttggtcttcttctcgataaatttccataaaatcgcgcggatgaattttcaaccgttttcttatatctgtcggaagaacaattcttccaaagttatctatatatcttacatagtcttgatttaacaaattgaccccctcctgcatctctagatataggcaattccctttttatcaaggaatgaagcgctccaatcggttagggaaaggataagttgcaggctgatccagtgattaaacacgcttcccatatatgatatatctgtttggtgcaggaccaataaaagaaaaaggatagcatgttgtgaggacaagttcttccttttcctgttgtagtgtaataatactttgatcatctttttttacaatctttgttttctcaatttcataggtaaaccgaccgtatgaaagctcaataacgagttgatctcctttcacaagttctcctgttcgtctaaacacagtatcacgatgcccagataaaacaatttgtccctgttcatttggtaaattgctctcgtgataatgaccaacaccctttgccaagtcctctgcttctgttccttctacaattggtaactcagcgtttaactttggaatgtgtaagagcccaatggtttcaccagccttcggcacaaaaggggaatctgtttcccccttttgctggatggctgcttgtgcagactggaaagattgatctacttgcctttgcccatcaacgatcctcatatatcctatcatcacaaggcaaatgcctgctgtgatcaatgtcgctgagatgattttttgaatcataaacgattatccgtttctttttcttcttttccatacaataagggatgcacctattaatacaagggcaaatcctgctagtaaaaggttgtacatttctgttgcagtgttcggaagatgatgaccaggtgtatccgtttctgaatgagaaggctgttctggattccctggcacctctggcacatgcggcggttctaccgttgttgaattttcaggtttgtctggttcgtcaacattctcgcccttcacaactgcgatattttgaatggttttaccttcagatcctttagcaaccttcgcttcaaaagtaatcgtatgccagtccgtatctttgatatcaccaaattgaccggtcaccgtaccttttgtgtagtctccgttgtcatcatcttttgcatctgtcacagcttgatcatctacttttaatgatccttcgacgtattcaataccttctggcagttgatctgcgatgactagacctttgatgacactgtcttctacactattttttgttttgatggtgtaaaggagagtgtcgcctacctgaacttgtttttcatttgtattgccctctgctttttgagcaatctcagatgttttttctgattcaagttttggatctcttggatcaatgtttatttcggttgtcggctcatctggtggcgtgttttcgcctgttactttcgctgtgttttgaatacttttacctgattggcctttagcgaccttcgcttcaaacgtcacggtatgccagtccgtatctttgatatcgccaaattgaccggtcaccgtaccttttgtgtagtctccgttgtcatcatcttttgcatctgtgacggcttgtccatctacttttagtgaaccttcgacgtattcaagaccttctggcagttgatctgcgatgactagacctttgatgacactgtcttctacactcttttttgttttgatggtgtaaaggagagtgtcgcctacctgaacttgtttttcatttgtattgccctctgctttttgagcaatctcagatgttttttctgattcaagttttggatttcttggatcaatgtttgtttcggttgtcggctcatctggcggtgtgttttcgcctgttactttcgctgtgttttgaatacttttacctgattggcctttagcgacttttgcttcaaacgtcactgtatgccagtccgtatctttgatatcgccaaattgaccggtcaccgtaccttttgtgtagtctccgttgtcatcatcttttgcatctgtgacggcttgtccatctacttttagtgaaccttcgacatattggagaccttctggcaacttatccgtgatgactagatctttgatgacactgtcttctacactattttttgctttgatggtgtagagaagggtatcgcctacttgaacttgtttttcatctttattcccttctgctttttgagagatctcagatgttttttctgattcaagttttggatctcttggatcaatgtttgtttcggttgttggttcatctggcggtgtgttttcgcctgttactttcgctgtgttttgaatacttttacctgattggcctttagcgacctttgcttcaaaagtaatcgtatgccagtccgtatctttgatatccccaaattgtccggctactgtgccttctgtgtagtctccgttgtcgtcatcttttgcatctgtgacggcttggtcatctacttttaatgatcctttgacatattcaagaccttctggcagttgatctgtgatgactaaatttttgacgatgctgtcttcttcaagattctttgttttgatcgtgtagagaagggtatcgcctacctgtggtgtcttttcatctgtgttaccttctgcttttttctgaatgctcgctgccttttctgatgttagttttggctcacgagggtaaatttctgtttttgttgttggctcatctggcggtgtgttttcacctgttacttcggctgtgttttgaatgtcttgaccagcctgtcccttttcaacagtgacttcaaacgtcactgtatgccagtctgtgtccttcacatcaccaaaataacctgtgacctttccatctgtgtagtcaccgctatcgtcgtctttcacatctgtgacagaatctccatcaatttcaagagacccagtgacatacttcagcccttttggcaattgatctgagatgactagattttcaataaggctgtcttctattgtgttttttgttttaatcgtataaaggagggtgtcccctacttctggatgcttctcatctgtattgccttctgcttttttctgtaaaaccgctgatttttctgattcaagcttcggatcacgaggataaatttctacgtttgttgtcggttcatctggtggtgtgttttcacctgtgacactcgctgtattttgaatgtctttaccagactgtcctttttggatcgtgacctcaaacgtcacggtatgccaatcggtatccttaatgtcaccaaattgtcctgagacagttctatttgtgacatcaccattgtcttgatcttgctcatctgtcaccgcttgtccgtctacctcaagtgaattgggcacatatgctaatccttctggcagttcatctgagatcactaagttttcaacaagactgtcttctatcgtattcttggttttaatcgtataaagaagtgtgtcaccgacctctggatgcttctcatctgtattaccatctgcttttttctgcaagacggctgatttttcagaagtcagtttcgggtcacgaggatagatttctacattcgttgtcggctcgtctggtggtgtgttgccggttgtgacactcgctgtattttgaatgtctttgcctgcctgacccttttcaactgtgacttcaaacgtcacggtatgccatttcgcatctttcacttcaccgaacgttccagtgacagttccgtctgtcatatcaccgttatcatcatcttttacatctgtgactggatttccatctacctgaagtgaatttggtacataagataatccttgaggtaacttgtcagaaatcataagatcttgaatcacactatcttcaacagcgttacgggcttgaatggtatacagtaatgtgtcccctacttctggatgcttctcatctgtattaccatctgcttttttctgtaagaccgctgatttttctgattcaagcttcggatcacgaggataaatttctatgtttgttgttggattgtctggcggtgtgttttcccctttgacattcgctgtattttgaatatctttacccgcttgcccttttgctactttcgcttcaaatgtcacggtgtgccaatcggtgtctttcacatcacctatttgacctgtaacagtaccgtttgtaaaatcacctttgtcttgatcctttgcatctgttacgcttgtgccatctaccttaagagatccagaaacataggttaagctgctcggaagattatctgatatgatcagatttttaagaatgccgaattgcaccgtattttttgctctaattgtataaagcaaagtgtcgcctacttctggatgcttttcatctgtgttaccttctgcttttttctgtaaagtaacagatttttctgattcaaggttaggaggatatggatcgaattcaggcttcacccttgaagctaagtcgtaagataatgaatcacctgcagtgcccatatatgttgtacttaatgttttcgcatcaagtgtaaaaagagtagaatgaccaatagagtcatcttttcctgattgtaatagcatttgtccatttggcaaaaagctaattcctcgtactcctccctcaataggtttaccatctgcatttgtgattggaatcactcgaatgacttcagctgtttcaggattcatttgcgcaatggatccactggtattagatgcgaaccaaagatagccatccttatcgacgacaaggtctccgccaatgtctccgccaatgccagggccaacgtcataaccgacaattttcttggacgttttttgaccagttgctaagtcgtacgttgcaaggtagggttctccatcaaccgcatacgaatgaatatatttaccgttataaacaacggcattaggcgctcttccgcctaaaacacctacacgctctgcttgtccagtggtcgcatttattttataaagaactggctctccacttgctgtcgtagttgcatacacagtgttttcttgatcattcactgcaacaccgttcactacagtcgaattaattcccttcacctgtacactagcctttacgtttgttggattttgcccatcaagctgataaagaactaacttcccatttccaatcatgtaggaatctgcgttattgacaaccaccgtcccagcggctttcgtaacaggtggtgaaactgttaataaattcccagcaatcagcaccaatattagaaataattgacttgttctttttaatatgttcattttttgacatccccttttccctgctctaaatcataatggtatgtaccagttcacctcccacactttggtaaagaatatcagtaagatttcaaaagcctcaacaggactaaatgtctattttcgacaaaaatagacatttcgaactacatacctcctaatgattgacctgcttaagtttttccaataaaataactcttttcatcccaaattttcctcatctatctatctttccaaacaggccttatgatgtgaattacatacaatcctttctatttaaagataaatattcttcaattgggtaatgcttatttttttgtcagtatatattgaatttttttcattttctcttaaaaaaagggaatgattggcttgctttgttaaaaaaaacaagtcaaaagtcttgctgcttatcttgatgctttgacctttacgatgcgaaaaaattctttttaaaagtaagcgattacaattgagcaaagccatttaaaggggcgtgggagtatgttacgattgaattcgagtgtttaagaaagaagggaaagcttttgaagcgggaacatcttttacgttggtttttttattttgttggattgatcgtactagcttttggactatcgctgacagtgaaaggaaagattcttgggattggtccttgggacgctttccactacggactgtttcagcattttggactcacgattggacagtggtccatcattattggtgcactcattgtgacactgacttctgtttttacgaaatcatttccaaagatcggcgcattactgaacatggtgctgattggtatgtttatagatttctttaatgcggtattgcctgcaccacacgggtatttacccgctttatatgtgtttattacgggcgttgtggtttcaggttatggtgttggcatttatgtctcagcgaatcttggagccggaccaagggattcattaatgctgctcatctcagcgaaaacaggattaaacgtgcagtgggtgcgaaatggcattgagttaaccgtgcttttatttgcatggatgctcggcggaccaattggcgttggcacgattctgacggctattttcacaggtctcgtccttcgattctccttgccgcaatcgacacggcttctgcagctgcttattacaaaaacagcagagaaacctgttcagacacttatccgataagaacaagccattctacaaaaagaatggcttttcttgtgttaaaataaataaacagaatattctattattggagatgagacctcatgcagcttttccactatcattactggacaccatttgttgaagagaccgagcagtcgtatcgcttgttaggctttgaagtaaaggcgcgtttcactaagggtggctcctttcatccgccgctcacatgggatgattttagagaagagcagccgaccttccgaatcgtcgaaatgagaaagggacaaatcaatatcactttcggttatagtaaaaaagtcctttttgatcatattggctttcttgtctcagacgaagaatatgagaagctgctttcacaggcaaaagagctcaactggccggtccaagaaggagaacgaagaacgtttctttcaacacctcttcgtttaagatttgaattacagcggcgtacagatgtcattgagaccgggaacgctacgcttcaagccatgacaattgctgttcctgatttgtcacagacacttaaagtggatcagctgctttcttctttgaatcagcccattcactggcaaaaaggagaacgcctctccttacttaacgtgatcatgactgattgcgatggattagatgcgaaagatccgaatggggttcatatcctgaaacagacgtagaaggacttactatttgtgaagaggatttcccttttgtacggtgctctccaatggtacaatcaatgtaaaaaattagaggtttgttatgaagatatttgctatccaattacagcacttagatgaaatcaatgaacgacaacaaatagagcgtctgaaaccctttgtttcacctgaaaagcgagctgcggctgagcgctttcgttttttaatcgacgcaagaaggaccttgttaggtgaggtgctggttcgtcaaaggatccatgatatgtacgatctgccttttgatgagatcgtttttgaaacagagggcaatggcaagcctgtcgtgcggcacattccttcttttcattttaatctttctcactctggtgattgggtcgtatgcgcaatagacgatgcacccgtaggtattgatattgaggagatcaaaccgattgatctagcgattgctaaacgatttttttcagcagatgagtatgaggatttactttcacaaccggcagaacggcaggaagcctacttctttcatttatggtcaatgaaggaggcctttatcaagctgactggaaagggattatcttatggtctttcatcctttacagcccgtctgtcagaggatggacaggcgacgttgacattacctgatcatgaagcgccctgctttgttcaaacatactcacttgatcctgcctaccaaatggcggtgtgtacaagaaagccttctgcggctgaacgagttgagatcctctcttgccgtgatgtgctgtctcgtctttaatatcgcccaatttgctgaaatgctgtctttaacaaatcgactccacgtgtcatttgttcttcttttacatgccaaatgtttaactgaagaatggggtctctttgataggtcgacagataatggcggtcgattgactgaatggaaacagatgcctttttcagctgctgaatgagctggttcatcggaattgaccgatcgagacgtacatgtgtatgagtagctggctcctcttctcctagttgataagcgatttgatcgcttttcaggcatgtcactagctgtttggatcggttgcgataggttgtctgcattctgtctcgatgccgttcaaacatcccgctttttaagtatatttctaaggctgcctgtgacagcatggagctgtcaatgtcaatgagccgtttgtgttcgctaaaaggtctaatcagctcctcaggtaaaacgaccgcacctgttcgaagtcctggaaagatgattttggagaagctttttaaataaatgaccttacccgcctgatcgtatgaatagattgggtctctttttgcatcgaattctaaatcggctatatagtcatcttcaacgatatagacgtcatatgtctctgcaagagctgcaatcgctcttttctcctgttttgacaagctcgttccaagcgggttttgaaatcttggcatcgtatagaaaaaacgaatctcctcttctcgaaagatgcgctccaattcctgaagatcaattcccttttccgtccgctgaatcccccgcacaggcagttgatttttttctaaatattgaaggtataggtgatagcctggctgttcgactagtatggtctgtttgccattcggaaaagggatggtgcttaaaatggataacgccagctgaataccagaagtcatgacgatttgttctggatttgcaaacacttgataatccattaatcgcttagaaatgactggcagcagcgatggtaatccgttggctgtgccgtaaataaacaagtcattttgatacaaatcgatggcttggttgatgcagtgctggaaatcgacatatggaaacacgacgggatcaggtgcagatgaagcaaaatcaatccatgcgctatcctgtttccccgctgactgttttgttttcacgacatagtatccgcttctttctacagaatacagcagatgttctcgttctaatgtatctagtgctttaatgactgtgcttttactcactgcatattgtgccgccaaatggcgaatggaagggatcttcatacccgcatgatattcaccagatgtcatcttctcttttaagctgagaacaagctgatcatttttcctcacaccgcttcctccttgtaccggtacagatatcatgttctcttattgtacaccttagatgatccgattacgatagaagaacagaaccggtcaattcatctgaagcatgcatgctcgtataaggagtcaaattgtggacatttcaaaacagaaagcgtatgctgccgcgataggctacgccacgatcattggtttttcatttttgtttgtcaaaattgcattagaatcagcaaatccaattgatttattggcacaccgctttacaatttcttttgcagccgcactattgctgtatccatttttaagaaagaagatccgcctctccattcaatggcgagatcttctctacatcgtgccgttttccttactttatcctgtgttgttttttgcttttcaagtatgggggctgatgtatacctcttcgtcagaggctggtattattcaggcaacgattcctattctaacaatggtgctggccgcgtggtttttaaaggaacgcgcaacatggatccaagtgctgtttaccattctttcggtgtgcggagtgatgcttctctttgtcatgaagggaattgatgtgaagcattcacacatgatcggctatatactgatattactttcagccttatcctccagtgcatacagtgtatttgcccgggtgattacacggcgcttccatgtgattgaactcactttcgtgatgacattctttggatttgtcttcttcaatgccgctgcgctcatccggcattcagtaaacggaacaacgctgcaatttttcagcccatttacacaaccatcctttgtatggtcaatgctctttttaggcattctttcttcacttctcacggcatatttatcaaactatgccctttctcagcttgaagcggcaaaggtcagcatctttaacaatttatctgcgtttattacagtcgccgctggggtcctcattttacatgaaacaatcgattggtatcatctcatcggaggtgtgctggtcattggcggagtgattggcgggaatgtagtcaagaagcggaattcataagaaaaagcggtccctttaaagaggaccgctttcttttaatgtttcattaattgtggtttgcctgcaaggtcgatcacatgtctcatctgttctgcaaaggactcgaggtgtgtgttgatatacatgtgccctccttcgaaattggtgcgttcgatggtttttgcccatggcagccagccgtttgcatcttgcatgcatttttcatcttgtgttccattgaataaataaacaggtgtttcgatgatggattgatctttgtgctggaaggtttccagcgcctgatagtctgcacgtaaggatggcgtaaagtaatccatcattggtttgttctctaataattcctttggtatcccgcccatttcggcaatatgctgaacaaatgcttcattcgataaatgggtcaggatctgtcgttttgtttgcggcggctgaatggctgaaatcacgactgctgcaggatcgattccttccttttctaacagctgcgtcagtctatacacgacaagtcctcccatggaatgtccgaacaggataaacgggcggttcaggttgcccgaaagcccttctttgtacagctcagccaatcggtcaatgctcgtttcgagcggcatgagattggttccatgacctggtggctctgctgctgttacttcggcagtgccttttagctgttcaaaaagcgggcggtacgaggcggaataaccacctgcaaaaggaaaacaaataagctgaataaggtctgattttttttcaaaggttttaaataaatgattcatacgttcttacccctttatcatcgtttgaagaattcgtgccagttcatccgcctgcggccttttcatcatggtgacatggtctcctttgatgtgataatacgagcacgatcctttcgtataagcctcccaatctgagaacttcttctggaaatcaatggcgtgatcactgctttgtacaatataaaacggcacatcgaatggttctttttctaattcaatggcttgtgacatgattgtattgtgcgtttgcatttgcaaatatttatctaaatactgatcattcataaattgatgaaccacttcatccttttctgcctctttgagtattctttgcttcacttcttggaagctcagcccttgtaatgcttctggctggataccgacgagatttcccattccaaggacaagtgcaagcatttttacttcttcttcgttcatatccgcatgaagcgcctgatcagcctcatctcttaacaccgggaccgtatctaaaatgatgagtcctttcggcgcttttcctgcatggcagagccgctgattcattccgtaggcaaggtgcccacccattgaatgccctgctagatagtcaacaccaggtcgatagaaggtctcaatggcttcaacaaatatagacacaagctctgtgtaatgaaggaattgcggttcttcatcctcatataagccaggagactgcaaggcgtacacagcgccttgctgtgtcatcagcttagccacatcgatatagcccatcaccgttccaccggcaggcggtgcaaagaaaatcctcggctcggctggatcgccttttttcagctcaatcacatagtcctttggagacctttcggcgtgctccccgtcctctggcattgcgtccacatgtgcggctagctgagccggtgctggatgcatgaaaatccattttggatcaacccgaatccccttttcttttaatttggctacggcttggatactcataattgaatcgccgcctaaatcaaagaatgagtcatgtatgcctacttgtttaacaccaagtacgtccttgaaagctgtgacaatttgttcctgcgtttcagtgactggtttgtcatctccctgagaatgagagatcgtttctgtcggctctggcagtgctttttgatcaacctttccgtttgttgtgactggcatttcgtccattacaataaagtaacttggaatcatgtagcctggcaggctttcctgtaaaaatgctttccaccctggatcaggattctctccatctgtgacaagataggccgccagccgttttgagctgccatacgttttggcgatgactgtacattcttttacttgtggatgtttgaggagagctgtctctatttctccacattcaatccggtagcctctaattttcacgaggttgtcttttcggccgagatattcaatggtgccatctgaacgccatgtaccaagatcacctgaacgatacagcctgtctccccctagttcagggaatggattgtctataaaccgttcctgcgtccgctctggatcatgaaggtagccttttgccagccctatgccgccgatgtaaatttctcctttgacgcctgctggcactggattgagcgcatcatctagtatgacgacagttgaattcgatactgggacaccaattggaactgaccttgctccctctggcatgtgcgtgacttgatgtgttgtggctagggtcgtgttttctgtaggaccgtaagcattgatgagtacaccctccatatgcggcagtgcttttcgtgcatgctcgctggacatcgcttctccgccaacgagtaatgtgcggtagcctgctacactttttggatcgtgctctaccagccgattgaataaagcggttggcagacagttggctgtcacttgatatgctttgatcagccgtgataattcatccatattcagtgcggcatatttcggaattagaatgagttgaccgccattcagcagcatgccccataactcaaatgtaaaggcatcaaaagcatagtttgagagctgaagcatcttatcatctggacctagtttcatataatttgtttctctcaccagacggacaactcctgcatgagggagcatgacgccttttggtgtacctgttgaacctgatgtgtagttgacataggctaactggtcttctccaatgattgattgttctctttgatacactgcatctgtttctggtaatggcttgtccatgtcaatctttgtacctgtaaagtctactagacgctctattaaatgagactgagtgatgatcacatcactttgcgtatcgcgaacaatgaggcggattcgcgcatctggatattctggtgacatcggaacatatgcagcaccagatttgacgatgcctagcactgagacaatcatgtcaaaggaacgatcaaaaagcatcggtacaagtgaacccggtccaactccttttgactgcaagtaagcagcaagctgtgttgccttctcatccagctcttgatacgtcatgtgctcttccaaataagacaaggcaatgcggtgcggatcacgctgcacctgttcttcaaacagctcttgaatggtccgttttggatatggcgtagccgtttggtttttcccaataatcatcgcagcctgttccgctttatccattaagcaataatcagaaaatgtacgttcaggctgagccgtcataccatctagcagatgaagataataattcatataccgatgaatggtctcttgatcaaataaatctgtattgtattcaacatggatggacagctgatctccgtgttcaaatacatgcaaggtgagatcaaatttagacactgtatgatgaaccatcacatgttcacttgtcagtcctttgagattgacatggagagaatctgttacataccccatggccacttggaaaataggtgatcgacttaaatctctatctaacgaaagatcatcgacaagcttatcaaatggataacgctgatgctcaaatgcttttaatgtcatctctttcacgttttccatgacatcagcaaacgtagctgatgtggagatatcctgtctcagcgcgagtgtattcacaaacattccaacaagcttctctgattgcttggcatcccgccctgcgatcggtgagccaatgatgatatctgtctgtccagacagcttgtgaagcaggacgtagtacgccgacagcatcgtcataaacagcgttgtgccctgctgcttggacaaagcctgcaaacgacggataagcgtatcttccaaaacgatttgctctgtagcgccgttaaatgtttgaactggcggacgaggacgatcaaacggcagctctaacaccggaagatcaccttgtaaatgatcgagccaataggcttggtctgcttgatgatgcgttacttgctcattttcccaatggacataatctgtccattcgatttccagcgctgggagctgcggcgattcatctgcaagaagcccatcatatgccacttctaattcctgaatgagcaggctgagcgaccatgcatctgaaatgatatggtgctgcgcgcaaagaagataaaattcttcattgcccatatctacaatcgtccactgcgcaagaggccctctttctaaatcataaatgcgattcgcttcttgctgaataagctgcttgagtcttctcgttcttgttttttcattaaataatgagaagttcgcaactgtgacggatggcggaaggtcttcacgtatcagttgaaccggcttgccgccaagcgattgaaaagttgcacgcagtgcttcatgacgtttcgttaagagaccgatcgcttttgttaacgcttgaatgtgcaattgtcctgtcagcttccaagcacctaatatattgtaatgatggctcttttctaatgtggataagaaccaaatacgcttctgagcatgtgacagctcatagcttgttcgcttttccagctttggaatattggcttcctgaacagccggtgcctctttgatgtcatccaccatttgcgccaaatgtgccaaatgcttgctttcaaataatatttttaaaggcgccttgattgaaaactcatgattgatccgtgaaatggtttgagtcgcctttaatgaatgtccgccaaggtcaaagaattgatcctctttgtacacacgatcaacgtctaaaatgtcctcccatatggcagcaagcaattgctctgttgtcgtttctggcaattgtttttcgagaggttgtccatttttgtgatgattcagcttaagggcttcatgatcaatagtgccatctagtttttttggtatttcttgtacttgctgaatatcccagtcaccttttgttccacctgcgatttcttcaacatgcacctctttgccaggctgaactgtgtaaaaaagctttttctcaaaagtcggtattggcgctggctgaagatacgctgcgatttctgggttggctccgtctaggccgataaatagatgcgcttcattcagccgagcacctagacagaatgaatggagaccttgcttctttccaatcaattgaaatcccttgcggacggtaagggctgcgccggtatgtccctttgacaaaccaagattatcccacatactgaagttcaaagagatcgcccgtcttccttcttgaaaggttagcgtgtgcgcaagcccatctaaaaagctgttggccgcagagtaagccccgaatgttgtgccgccaaaaaagccattcactgatccaaaaaagacgagtggtactgccgggtcatgcttgaaggcttcctgcaggacaaacgctccgtctgctttccctgacagttccttcgtaaaatcctcttctgacgtatgcgccaatgtatacttattcgtttgctgaaaatgctcagacacattgcccgctccagctaaatgcagcacgcccctgatggattgcccaaaatgtttttctgctttgtaaatcgcctgctcgacgtcagttaaatcggtcacatctgcttgtacatagatgacatcaccgaggtcttttagctgtgagaacgcttctttcttttcaatgttggcttccagagaagtccttccaatcaatacaagctttaggccaaattgaagcatctgcttagacagttcaaatccaataccgccaagtcctccagtcagcaaataaagtccttcatattctaaaaatccttctgtttgaggtgcttgcatcatatcgactttttccagctttggtacaagcctgtgcccttttcggtatgctacctctgcttttatatgaatcgccgacaactcatcagcaatgttctttgcatcctgttccacttgctccgcttcaatatctatatgggacacctctgctccatcccattcttgcgggatggtttttaacaaaccaacgagcgacgttttctccacatgaagatcgtcatcagggcttacaaattgaccaccctttgtcaccacaacaagccggactggctctttgttttcttgcctccatgcttgatacaagtacaaaatagattgattggacctcgcatgcacttctgtgaactgcgcaggctcaacgatggcttctttgtctgtcacattccacaggtggagtatacaccctgtctttaattcatctgcttcaagtgctgcaacgagcctgacataatcccccttgattctcgggttcatctggtacatccctttggacagacgcaaaaattcatgtccttttttcacagaaacatagggttgatttctttgttccaattgggcgtaaagtgattggtaaagccctttttcatcctcgaaaacgagtacatgatcagcagcaggctggtacggaccaatttgctcctttgcccaagtgcgtttgaaaaaccaatctggcagtgtttgttcattttcagaagcaaggtccagtgccctttcaatgtcacggaataccccttcttttagcgccgcacctaactgagcacgttggatctttccactttctgttttcggaaattggttcttttccactggaatgatgtgatcaggctctatgccaattttacgaatgatggctgctctaatctgctgaatcatcgtgatttgttcctctagcgaatccttttgtgtgacaaagaagacggcaagtgtgtcgttgcttgattcaggattgtaaatgccgtacgcagcggcaaaggtgacttctaccccgtccacctcttccacaactgcttcaatttcgtaattcaaatagttggctccgttgatgacgatgatgtccttttctcgacctgtcagaacaagacgcccttcgtgaataaatcctaaatctcccgtgtgaaaccagccgttttccgcaaatacctcttgattggcttcctcattttgatgatagcccatcataatcgtcggactcttcacctgcaagcgcccgacctgatcttctggcagcacatgatgatgctcgtctacaatccgaatccatacagacggaatcggtgcgccgacttctgtaaatgtcattttgtgcggatgatcttctgccacgtattggatctcacctgttaacgaggtctgatcaatcgtcagctgtccatcctgatcatcatgccgcatgaatttctttgattgaacaatggctgaggatgtttcagacatgccgtacgccggcaccatcgcatgacggcttaatccgtgctgacccatcatatgcatgaagcgctgcgtcacttttggtacaactgcttcggctgcattcatgatataagtcagtgtagagagatcccagctccccttgcgaatgccgtcctcatattcattcatcatcgcaaaagcaaaattcggtgcccatgtccttgtgacgccgtatgtttctacccaatctagccacaccatcggccgttcgataaattgatcaatggatggactaatctgctggcagccaaagtagacgtcatgcacatgaaacatgacaatgcctcctacatgatcaagcggcatccagttaagcgacacatcctcatgcgtaaagccatttgtctgctcaaaggagatgattctagataaaatgctttgatggttgtgacggatacactttggcacacccgtacttcctgaagagagcagctgaagcacaggctcatctggctctggctcataatgctgttcatccggctcacacgagagcaatgtttcgattgttaaaataggcatgtcttttgcttcaaatgcctcacgcagcccagcaatgtcctcagtacttgcttcattcgtaataatgaacggttcattttgaagctgaaacacacctttcagcttgttcacagcttgattcgtttcatcataaacaggcggtacagagactggggtcggaatgatgccaccgagaatacagccccaaaacacagtgatgaaatcttgatgatctttcaattgaagtaacacttgatcaccgtttgtcagccctgctttccttaaaccagacagaatccgttctgcatttgtgagtaactcaggataggtttgggtcaacgtgcgcccgccttctttgatataggttaccccgcgttcaggtgacataaaggctgatcgaatcaacacctctgtcagtgtgacaggtgtgcctggttttttgatgacatccccgccatacactagtgcgggcggcttttcatgggcagatgcttgcactatttcgccctcttcatccttcgagatcgatacgttcccttgcgcacgctgccgattaggaaatagatcatctaggtgataaggcgtttgtttttctgtctggctttcaatgagagtggccgcttcattcactccatctatggctttcgtccgttcttctatctttctcaaactctcttcatccatgatgtcgattgaaagcagcgcttctgtatcgactgctccactttctgcccttggcaaggaaggcaataagacgagagcggctggcacttcatcagggtgaagcacgcctgtcatcagatcctctcttgtcagcgaagggtccttcgcctgtgcaaataacacaagcgagaggctgccttcttcatttttcttcgggatgaatgcacattcctttagcggaaaatgaagcatcatgacctgttctaatgctttgagatcgattcgttttccgttgattctgacgatatgatttgctgcatggcctttccttctactcattaacatcgttcttctcctcctacacccaatccaaaatctgaatcttgtttttttcagtccaaacgccgacatcccctgtcggatagaggtattcgcctgtttgatgtttgaatggatgcggaattttatgcgtctccatccaatcggcaagctctccgcaaagtgccttgataccctctgcaccgataaaaatatctccaggaaatcctactggcatgagctgatgctcttcgctcaggacatagatttctgtctcacacgaaggatcatgcacacctgagtagacctcttcttgatctggatacagcacgctgacttgtgcatttttcgcccaatcggtgatcatccgctctttttcttcatttgtcacgatcgtgaaggaagagagtggtgtctccacttgttctgtcatggcttcaagtgtatggaccagctgctgcatcagtgattgtatttgtttctctgtatattgattgaagcggtatgtgacccgaagctccagcgtatctcccgggacagccacaagggtcaggtcatagtttgtttcttcatgactggctatgtctaagatccgtacaccatatggttctacagattcaatcggatagttttcaaacacgacaatgctgttaaacaatgattctccattcggaatttgggtcatctgctgaatatctggcagtacggtatactcgaattctctcatgtgaaaaactgtttcctgcgtctctgtcagcagctcggcaatggtcttatctcgtgtgatcggcaaacggagcggcaaggtgttaataaagagacctgtcatgctttcaacctctggtaagtccgccggccggccagatactgtgacaccgaacacaacatcctctgagcctgaatgaaggtgcaagagcagaccccacgccgcctgaagcagtgtgctcatcgtgaccttctgtctccctgtcattttctccagcttctgctgcatgtcaggcgtcagtttgatactaatttgatcaatacctgctcctttttccgaagcttgctctccgtctcctggtagtggtgtggcttcctctacccctgacatgtaatgtttccagaattcttgcgccttcttttgatcctgcttttgcagccactcaataaaatctttatatggacgtacagcaggaaggttcatctctcgttcatccacaagcgagcgatatattgaaaaggattcctcaatcaagccgaacaggctccagccatcaattaaaatatgatgaaagctaaaaacaaacgtgcaagttttctcatcacgatggaatagagcgatacgaatgagcggttcagccgcatcttctaattcgaaatcctttgaacgatcggtttgtaaatactgctcaatggttttcttctgatccatttcactcaggcggcgcacatcgtgttgaatgaggtgaatgactccttctgattgaatcaattggacaggctcctttagcccctcccaagcaaatcttgtccgtaaaatcgaatgacgttctacaagcagattccatgctttttcataggctccaccgtccgttaaaccttcgagcgtcatatgcacctgaccaaaatacgcctgtgacgcttgatctaacagtgcatgaaacagcatcccttgctgcatcggagatagtggatacacatctaccacattgtctgggagctcatctatttgcttttgcgtcatctggaccattggaaaatcagatggcgtaaagccgccttttgtctctacacaatgcgtcagaatatcctccattttttctttaaatcggtcaggtaattgacgcacctcttcctcctgaagcagttcacgattgatcataaaattcatctgaagctgcccattgacaacgtatccgtacacatcgatcaaatgctgtctttctgcttttggatcatgtacatgcccatttcgctcatctgctatatacagatttgcctcaccgtctatttgatctaactgtccaaggtaattaaagctcacctgtggcgctgccgttttaagtaaacgcgctgctgtcatgtattggagtaagccatagccgatccccttttgcggcacagctcttaaggtttctttgacatctttgatttgcctctcaacatcggtttgaataaaaggaataaaaataggataagagcttgtaaaccagccgactgtccgtgacaaacccatctgttcaaataaatcttcgcgtccgtgcccttctaacgtgatcagtaatgactttccaacagcttgcgcgagccctgataagagtaaatcgttcacttctgttcggtacgcttgtgatgcgtgccttagtaaaatgtctgtttgatccttcgtcaattgaacagtcaggatctctgcatgttcttctatattgaaaagcgcaggtgtttgaaaaggagaaccttcttcctcttgatcgatgattttttgccaaaaaggaacctgctcttgtaattgatcagtttgtgcaaattcatagagtgcctctgcccactgctgataggaagcggttttcttagcaagcgtgatctcctgccctgccgcagcctgcttcaacccatttaagatatcttcctgtatgatgcgccacgatattccatccatcacaagatggtgggctgcgatgaagagttcagacgtgcgatcacttgtctgaaaaagaataaatttgatcaattctcctctctctaacgacagtgttccttgacaagcacttgtctccatacggatttgctctatcgcttcctcgtgagaaacatccgtcaaatcaaagaatgtgacacaagggatgatgccgggcgcacgaatggtttgaatccatgtgccgtctgcttcttttgtataaatggctctcagcatatcgtgatgatcgacaagttttgaaagaacttgtgttaactgctcgggttgtatagattgcttgatttcaatatgagctgatagattccaataatcttggtttgtcatcgattgctcaaggaaccaagattggattggaagcagacgtacatctcccgtaacaggtgattgatcataagacacagatacatctgcttttttcatcgcgcgtgccagctgtgaaatggtctgtttttcaaatacatctctcggctgtatgatgtagccttcctgtgctaggcgtgccaccatttgtatgacaataatagaatctccgccaagctcaaagtagttatcatgaacaccgattgaaggagtgccaagaagctgagtccacaccttttcaagtacttgttcttcctcactgagtgcctgatctgctggtttgtctgcttcttcctgtctccacactggcggcgggagacgcttttgatctaccttgccatttggcgtgagcggcagttcctcgagctctatgaataggctcggtaccatataatctggcagtcgatcttttaacttgcggcgaaggtcttgctgggtccatgcacctttttggacaaagtaaccgatgaggcgcttatgaccactctcatgctgatgcggaatgaccgcacattctatgatgtcttcaacactcagcatagcggcttcaatttcgccgcattcgacgcgatgtccgcgtattttcacttgatgatcgattcttccaaggcagtcgatgatgccatttgggagccagcggcccatatcacctgttttatataaacgctctcctttatggaaaggatgcgggataaatgattgcgatgttttttcttcatctccaagataacctagtgccagccctgttccaccaacataaatctctccaatgacaccttgcggaaccggctgcagctggtcgtctaatacataggcttgtgaataagcaattggctgaccgatagggacggtcgtctgctcttcgtctaatgagcgaatgtgatacacacaagagaacgtcgtattttcagttggtccatagccgtttaaaagcccttcaggtaaatatggcagtgccttgcgaatatgagctgctgatagcgcatcaccaccgaccaacaatgcatcgaatccagataaagcttctggatgttcctccgtcaatcggttgaacagcggcactgtcagaaatcctgttgtgatcttgtatgacgtcagcgtgtcagccagtttatccattgataaaagtgtatttcgatcggtaagaatcagccttcccccgtttagaagagctccccatatttcatacgtaaaggcatcaaaggagaagctggccatttgtaaaatgcgcgtatgttcatcaaaagtgacatagtttgtttcacagacaagccggatgactgcttgatgcggaatcaaaaccccttttggctgtccagttgaccctgaagtgtaattgatataagcgagtccatcaggttttagggcagcaggtataagttctgcttctgataaaaattcttcatatccttcatcaagacaaatgagttcggtttgactgatggacacctttttcagccattcattttttgtcagtaacagctgaatacctgtatctctcagcataaaatcaatgcgtgcatctggatattcaggatcaatcggcacataggcgcctcctgctttcacaatcgccagcaccccaagaatcatttcaggcgacctgtccatgagcagtcctactggttcatgcggcgtcacacctcgctgctgaagagaagccgccagccggtcgactttctcttgtaacacatgatacgtccactgctcttccccgaattcgagagcgatggcatcaggtgactttctcacttgcgcttcaaaccgctccgtaatgagaagcgggcctgccggctgatccattttgccgctccattcatagagcagctgatgcttctctttttctggcaggtaattcatttgtttgatcggctgtgctggattttcacaaatacgcccaagcagctgctcgtagtaccgaaggaaccggtccatcgtttcgtcagaaaataagttcacatcatactccagttttaattgaagaccctccgctccttcaaagacaaacagagatagatcgaatttggcggtatcgttatcttcaatagctaaaacagatgtcgcctcccccattggagaagcctcaagcggcagattttgcaaaacgaacatgacctgaaacagcggctgtttgccagcctcacgtacaatattcagctcatctacgaccatctcaaacggcacatcctgatgcgcataggcgcccattgttgtttctttcacccgttctaatagatcagtgaaagcaggattcccgctatgatcgatccgaagtgccagcgtattgacgaaaaagccgatgagttgttccatctccgtccgatttctaccagcaatgactgacccaatcacaaactcatcctgtgaagacaaacggtgcagcagtgttgaaaaggaggtcagcagcgtcatataaagggtactgtcagtttttttagaaagctcagccagctgatctgacagcgacttcgacaggtggtattttttcgtttttcctttgtaggattgaacagctggccgcgggtagtcatacggcaaaaccaaatcttctacagggactgcaaattgctccttccaataggaaagctgcttctccagcgtctctccagtcaaatactccttctgccatagggcgtaatccgcatattgaatcggcaaaggcgatagattaggctcccgcctgtcgatcattgctgtataccattcagacaactctcttgcggcaatcccaaccgaccagccatctgacacaatgtggtgaatggacatcagcagcaaatgatctctttctgacagccgaatgagttttacacgaaagagcggatcatgctctaagcggaaaggtgtgcttgcctctctttttgcccattcagccgctttttgttctttttcttcctgcgacgtcaaatctgatagatccaccacttcaagctctggaaggatcatatgctcatggatcatctgcaccggttcatcgccgttcatagtaaaggacgttctaagcgactcatgcctttgcaccatttgctgaagactgcgctgaagtaccttcacatctaaagatccattcacccgaaaggaaattgtattattgtaaaatggcagatcaggctgtaattgatagagaaaccactgtctttgctgggcataggacatcggaatctcctggccctttgccattttccgtacctgtaccgcttcatccacttttgcatgcgaatcgatccatgccgctaattccccaagtctcgtatgctcgaaaagaacagcgagcggcacatcaaatcccattctttgtctcaccgctgacagcatttgcgttgccttgagcgaatgacctccgagtagaaagaaatgatcaccacagctgacatttgagacttcaagcagttcggaccaaatgcttgccaaaagtttctccgtccccgtttgaggcgctctgtcttctgcatcctgtccactttcctcaatgagtgctttgaaatacgcttcatccggcatgccatcctctgattctttccagtattcctcaggaaatagatggacggaatattcaccagatagatgagtctgcaaacatgtataaatggactgatacagccgttcttcaatggcttttgttttgtcggttttgtaaaagacatacacggctttctctgttcggctctccgcatgaagcatctcttgaatgtcctgcttcgaccgatctaatcccatataaatgagaggtgcatctgtcattaaacatgccagcatcgtctggaagcccgcccgcttcggaatcggaagatagcctctttcttttaacatacctttgatcatcgaaccctcgctcatgccaatctcatcccacatgctaaagctaaagcagtatggcttcacggtagatgtcagcctctgataatgagcaaattgttcaacgaactcattggcagcagagtaagcgcctacggtcatcccgcccttcaatgttcgtgctgatgagctggaaataaataagacgttcttccgtttagaagccgcttcatgaagcgcaatcgtgccatatacctttgcttcgtacatcgcatgtaaggacacagacgtcatgtcagcaagcagctcttcttgaatgatgccagcgaaatgaatcacgccatgcagcctttttccatgggccacctcttgtcttgagataagggcttcaagggcttttgcatccgtcaagtccacttcttcataatgaacagtgccgccgcgtttttccgcttgtttctcaagtgaggtcaatacgtcttgctgctccacagataaagctactcgtgcctttcttccaagcagaacaagatgcgcttgataggacgtcagaagatgttcacttagcatccgtcctattccgccaagcccgcctgtcatcacgtaaagcccggttgattcaaatggtggtgtcttcctcttttgctctctttctagatgaatcggcgttaaaagaggaatataacgaacaccttcgcggtaagcagcaatatgacagcttgtgtcctgtgtaagctctgtcatgatcgctgatgcatgggaacggtcagccgattctgtcagagaaaaatcaagacaccgcaccttgagaaacggccactcatgctgtacagctgtcatcaatcctgctgtcgttgctttttccacatgatgtgtttgatcttctggcagattcatcgcatgagcggagacaaaagtgatctctacaggttcctcataggcggcaatcgcttttgttgtatataatgcactcatgctgccaattttctgcgcttccttcgccattgctgcttgaagtgtgtcttccttgtttgtgtagttccaaaggtgaatgatttgtttcaccgaaacgccatacgaacggagcgcctcaaagagttgttcgtagtctgacggccgattcgggtggatgatgaagtgagtatgtgtgagttgtgtgaatgcttgacccggttcaaccgtaatataggtttgttcattgtttgatagggatttcaattgatctgccagacctaatgcatccgcaaagatcactgtatcccctgctgtttgcttttcagttttatgaagcggagcgggtgtccacttcttttgataactccaatcaggcaaggtgtgttcattttcaagtctgatgtccagttccttaatgatttcgtcaaattctccttcctgccaccttgtcttgagctgtgccctttctatttttccagagcttgttttcggaaaggcatgcttttggacaggaataacccttggtgcagaaagacccatttttgttgcaatatgggttttgatgtgctggctagccctcatgatataagcaggctcatacagcttcggtgtaaaaaagagaatcagttcatcggatgcagatgcctccattcgcacggagcaagcagccacaaagcttgtttctacgccgggtacttcctctgccatggcttcaatttcatagttgtgataatttttcccgttgatgatgatcatgtctttttccctaccagttaatgtcagctttccttcatgcagaaaacctaaatcacccgtgtggaaccagccctctgtttgaaaaacctcttcattcgcttcgtcattcttgtaatagcccttcattgtcgtcggccctttgatttgcacgctgccaatatgatcttcaggaagaagctcatgctcatggttgacgatacgaatcgtgatacctggaatcggtttccccaactctgtaaagctgacggttccagtgtcgcgtgcatccgctggtcttagctgctctgtcagcgatgtttcctcaaaggtcagaaccccgctgttttcatctccccgctcaatcgcaaaagagaagacaacggctgatgagatttctgacatgccgaaagccggtctgatgacgtctccttttaagccgtgcggagcgagcaagtgtaaaaaccggtggatcgtcttcggtacgaccgcttctgccccattgatcatgcacgacatggaagaaagatcccaagaccctgaagagatttctttctcataatcattgatcatcgcaaatgcgaagttaggtgcccatgtcttcgttgcacgataacggtccatccagtcaagccagcgcagcggctgagcgatgaagtcatctgttcttgcccgaatctgctcacagcctgtgtacacattgacaagatggaacatgacaatgccgccaatatgatctaatggcatccagtctaacgagacatcttcttgtgtaaacccattggctgcaaccgttcctttgacattcgccaacacacttctatgagaatgctctacgcatttgggcatccccgtacttccagacgttaagataaaaaagacggaatcatcaggcgtgactggatgtgcttctagatctctttctaaagtaagcattggttcaacggctgcaacacgtaattgatctgtatgccacagtaaagctaagccttgcacctcatcaatcagcgaatcatccgtgagaatgagcggatgctccagcaggttccaagcgtgatgaagcttcttcactgaggcattcatttcccgataggtcggggctgccgatacaagtgttgggacaaatccgcctaatacacatgcccaaaaagccgtgaccatcgcatgattcgatgaaaattgaaagaacacaggatctcccggctcaaggcctagtgctcttaaacccgtcagcacccgctcggcatcctccttcaactgcgcgtaggattgcgtgagctcattttcactattgatgatataagtcagcccatttgttgatttggctgcctcagttagagcgtcctgcaaggtttgagctcctgcacgaacatctatatcccctccataggaaatggctgggggcatgtctgctaaaacaggtgaagccatttgcgtttgtatccattcagctgcggcctcctgctccatgtgatggtctagaaataaatgagagaggtgatatggccgaggtcgaatggttttttcacgagaaaaaacagcgaagcgttcgatttcgttggtttgtaaaatggtattctgtacatcttgtaaaatcgtatccattgattcatgtacattcgattgattgatggttgatggtttcatatgagttccttcccttttttgtcaggcagggctgccagtgtgcacccctgcctcatctaaagtttacaagactgtttctctatttttatgatggactatttctttaatgagctgtgcatttcggacggcacattctttgtttttgaacatgtcggcgtgctgaccaaagccttgaaattctcgataagcgccggtcgtcgcagtttcccatttatccatccattctggtatcgcaatatgctcttcggattggataaagtcaatgtctgcgtgtatctctccttggttcacccccttaacaaaagcttcatagtaagccctcgttttttgagcaagctcgtcttgaatgagctccgcttgggcaagttcactttgcttcgactgatggacgatcgcggcgatatcgtcatcaatggatcgtccttctaaatcactttctcctattttcttatacgaatcgatcatgatgaccttttcgacggtccgccctgcttgttcgagcgattgaacaagctcaaatgctaggtagcacccgccagagtaacccatcaaagtcagtggtccttcaggctgaaggtgctggatatgctgaacgtattgcgtgattcggtgatcagcttcaataaagtcaaaggcgataaaacgaataccatcaagcgtttttgcggcttcctgatagataaagccatagcccggtaatggtggtagagcaaagactgttggcgtttgagattcattgaatacaagatagcctgcagcttcctgatcctgctgttgaatataacggctgactgcttcaatggtaggtgtctcaaacagcaagtgaataggcacttgaacatcaaattcctttgtcaccttagataaaagcgacatcgcttttaatgaatgcccgccaagctcaaagaaatggtcatctgtgctgatatcttctctttcaagcacttcccgccacatcacaagcagcttttgttctacctcatttaccggaagcttcacatgacggtttccttgaggcacctctggctttggcagctgacgtttatcaacctttccatttggcgtaagtggcattttctcaagtctgatcagttcatgaggctgcatgtaagccggaagtttttcctttagccctgacctgatcacattgagtttatccttccactcctcctcacacgtcatataggcaagcagccttgtatgctgcgtgttatgctgatcagctataagggccgcttgttttacacctggatgcatgagaaggtgggcttcaatttctgtcagctcaattcgatgaccgcgaattttcacctgatcatccactctgcccgcatactcaatcaaaccgtccgctcgaaaataagccaagtctcctgtacgatacagcctttctcccgcagcgaatggatgcgtgataaaggcttgtttcgtcagatcaggacgattcaaatacccctttgcaagccctttgccgctcagacaaagctctccgaccattccaatcggctgaagctgtccgtgctgactcaatatataagcacccgtctggttgagcggctttccgattggaatcgaacgcgcttccatcggcagagcctcatcgactggataataagtggcgaatactgttgattcggttgggccgtagacattgatgagtctgcctttccccataacagcaaaggctttcctcacatgctggactgatgcccgctctccaccaaacagcaccttgcgcacactgcgcatccagtcggtttcttcatcaacgaggagattaaataatgctgtcggaacaaacatgacagaaatattttcccttttaatcaatcccgtcagctcgcccatgtttaaaatggtctcttttttcggcaagacaagcttcgctccgtttaaaagtgcgccatacacatcaaatgtaaagccatcaaatacgctgttggatagtgacagcagtgtatctgtttctgaaatggttaagtagtttgtatttttgaccacccgggcaatattcgaatgggtcgtcataatgccttttggctgacctgttgtaccagacgtatacatgatgtaagccgtatcgtgtaagcctgcttcaagcggcagattctctgagctcatcagtgaaatttcttgatcatctgcaaacagatacgttccatcaaacgcaagtgccttcacttgaccgataaaggatgagtgagtcagtagatgcgttgctgcgctgtctttaagcatgtattgaatgcggctttctggataatcgggatcaattggcacatagattgcacctgcttttaagacagcaagcagactgacaatcagttcaggtgtgcggcccgctaaaatggcgatgaccgtttgatgcgtgaccccatttttttgcaaatgtcttgccaatcggttggcttgttcattcagctccgcatatgtcatcgtgtgctcacctgctgataatgcgaccgcattcggctgtttgcggacattatgctcaaaccatttcgacaaatacagctggtcatgctcaagctcgggcgcattccattcctcaagaatcagctgcttttcctgttttgtgacaagtgtaagtgtatgaaccgattgatcaggatgtttgaccgcctccttcatcaatagactcagctgttcctttaaccgttgaacaaattgaggatcaaatgctttttgattaaaggccagcttcaattgcaattgttctcctggtgatgccagcaaattgagatcatagttcgatttttcatacacattcatgttttccacagtaaatcctaaccgctcctcttgctcttccttctttgcggctgggacattttcaaacacgacaatatgatccatgagtggctgatgacctgtctttgcctgaatatcataaattggaatgtattggtgcggctcggccgcaagagactgctgctgcgttactgacagaagagaacggaatgtcatgtcatctgtcagctgaattcttcttgggatgacattaatgaacaagccaaccattctgtcaacaccagccaaatctgccggacgccccgacacaaccgtgccaaacagcacatcatttgaacgctgatatctgctcaataaaattgaccagactgattgaaggacactgcttaacgtcgcattttgctggaacgctaactctgataaagcagccgtttctcccttgctcatcgaccattccaattcgcctaattcgtgttcattcgtttgctttctctgttctttaaaggtagattgtccatcaaacccagctaaagattgctgccagtattgaagtgatgcttgtttatcttgtttttccagccattgaatatattctttgtacggtttaaccggttccagcttgtaagggatatcatgcaaaagggcatgataaatcgcaaatagctcctgcaccacaagcccaaagcaccagccatcaagaaggatatggtgatagctccatatccagcgatagctggcagggcccgtttggaaaacagttgcccgcatgagcgcatccttcgaaaggtcaaatcctctcagctgatcctgttgtttaaatgtctcaatacgtacaagctgttcatcttcagaaagcttctgcatgtccaccacatcaagcgtaaaaggacgtttcttcagtacaacttggacagggcgcttcactttttcgtggagaaatacggtacgaaaaatatcgtaccgctccacgatgacattcatgcttttctcaagtaagtcatgacgcagtgtgccttttacgttcatatccatttgctctacataaaagcccttttcttggtgatggagggtatgaaacagcatgccttcttgcatcggtgacagataatacatgtcttgaacttgatcccttttaaatgaactcatctatttcatcctcccttcccgtttttatgtctgatctcatgttgctaagtcaatttctcctcaagcatgtcaaaaatgtcatccatttcatccatttcaaggtcaccagcagagaaatcacttggcgtaaattctcgttcgtgctgcgctaaacaatgagtcatgatggattggattttttctttcaacaatgccatgaactgctgtatcgtttgttcctcatattcatctgtacaataggaacacgacatcatgaatcgtttgtgttgaacaagaccactgagattcagcttatagacagcttctgaatcagggcttgcttgtcgtcccatatcataggcggacgttctaaagagttctgtcgtcacttcttgatcaatctgccccagatagttcaagctgatttcaggttgtacatgctgtcctgacgattcagtggctgtgaggtattttaaaatcccgtagccgatccctttattcgggacacgccgcagcatctctttcgttcctttaatagtctcagctatggtctgatccggctttgctttcagtacgactggatacatactcgtaaaccatccaaccgtgcgggagacatccagtcctgataaaatatcctctcttccatgaccttcaagctgcacatgtacacgggactcacctgtccactcctgaacagcaagaccgagcgcacatagaagaatatcgttcatttccgttgtgtacggtagatgaatgtcggtcaaaagatgctcggtttcggactctgaaagctgcatctgtactgcctttgtttgcgcaacttttcttttcgttacttcacgatcaacaggtaaagtggtgattggcgtcctgtcaatctcattccagtactcactttggctttttaacggcttggactgtgcgtatcgttcgatcgcctctgcccattctttaaaggagtgggttttgggcggcaggacgagcgtttgtccttgggctgcctgttgataaagagacataaagtcctctagtaaaattcggcatgagacaccatcaatgacaagatggtgtgtcacgatgagtaagtgatcgccatcttttgcacggaaacagatcactttcatgagcggacctgtttcgaggttcaactgacgctgatactcgttggcataggtggaaatggcttttttcacgacgttctctttagagacatcatgagaaattatcgcaatcggctctgtaagctcccgctggttgtattgcaggatgctgccattttcttgcctgtataccatacgcagtgcatcatgatgtgaaagtaatttctgcatcacttgttctgtcatcgaaaggtcaaacccatttggcgcatgaagcatcatcgagagattccaatggtgctgacttgtaaagttccgttcaaagaaccagcgctgaatcggtgttaacatgacttctccttcgacaggtgattggtcggctgttagttgatcagcttcttcgatatatggacgcagctcggcaatggttggatactggaataataacttcatatcaagcttccagcccgcttgtgtgagtctgcttgccatttggatgcctttaatcgaatctccgccaaggaagaagaagtgatcgtgaatgccgacttggctgacgccaagcacgtcttcccaaataccgcatagaagtgtttccacttcatctcttggcgcttcgtatgccgtttggttcgcttccatatctggtgctggcaatgcctttagatcgactttgccatttgccgtcatcggcaggtggtctagcttgatgatccatgaagggaccatatagtctggcaacgttcgttttagactttcctttaggtcagtcgtttcttcatctgtgatgacatatgcggcaagcgcgtcttgatcgctggcatctttgaccgttgtcacacgaattaacaggtacgttttgtcttgtttagttttcaaagatcatatttaaaaaatggagcgggtgatgagaatcgaactcacgacatcagcttggaaggctgaggttttaccactaaactacacccgcgtgatttgtattggcgcgcccgagaggagtcgaacccctaaccttttgatccgtagtcaaacgctctatccaattgagctacgggcgcttaatcaggcgacttaattatcttaacatatcgtttttatcaagtcaacatctttttaaaatttgtttgccgcatgtgtttgaatgtctttgtttcaaatacgtcatcagcgacgaataaaaatataccatggatcatataaaagggtcaatacatttttctaaaaaagtttcatgttttttaagaagtggttttttcttagataactagagatgcgatagccctattttcttctctttcttcataattctaatgattcttaaataaaatctttctaaatccaaaggaggacaaaacatggtcacatagaatttttatttattggaaaattcttaaaattttccaagcaattaaagggggtaggagatgatgaaaaagttcgtcgcttttcaaatcatgatcgctttggtgataggagctcttatcggccatttctttcctgacttcgggatggccctcaggccaattggggatggattcatcagattgattaaaatgatcgttgttcctatcgttttctctaccattgttattggtgcagctggcagtggtggtatgaagaaaatgggcagcctaggattaaagacgatcatttggtttgaggttatcacaaccatcgttctaggaattggtctattgctggctaatgttcttaaaccaggcgttggccttgatttctctaaattagctaagaaagatattggtgaattagacggttatacgcaaaaagtcgtcgactttaaacaaatggtactcgatatcattccaacgaatatcgtcgatgtcatggctcaaaatgatttacttgctgtcattttcttcgccatattatttggtgtagccgcaagcggtatcggtaaggcatccgctcctgttctcaacttctttgaatcagtggcacaaattatgtttaagctaacgcagatggtcatggtgacagcacctattggagtgcttgcattaatggctgcttctgttggtcaatatggcattgtgttattaatcccgatgatgaagcttgttgggactgtatttttaggattattcattattctctttgctttgttccctctagtcgcactgatcttccgttttaactacttcgaagttttaaaaatgatttgggatttgttcttggttgccttctctactacaagtacagaaactgtccttcctcagcttatgtcaagaatggaaaaatacggatgtccgaaaagaattgtctcctttgtcattccatctggtctttctctcaattgtgatggctccagtttatatttatcggtttcctgtgtgttccttgcacaagcgtttggtgtcgacatgagtttgtcacagcagcttttgatgatgcttgttcttgtgttaacgagtaaagggattgcagcggtgccatccggttcactcgtcgttcttttggcaaccgctcatgcagtaggtcttccagcagaaggcgtcgccattatcgccggagttgatcgaattatggatatggcacgaactggtgtgaacgttccaggtcatgccgttgcatgtattgtcgtatcgaaatgggagaaagtattccgtgagtctgcttgggaagttccaaaagcaggtgaagaaaccacaggaatgtagtgttatatgaaggaaagggcttcccctttccttttcttatgataaaaatgcttgctttaggaccgctttgccttgaggttgcagctgcacttctgcatatgcgccattaatcagcgtcatttgcggccgtacatgtccacaatctatatcgtaaaaaatagggatttgtaattccttttgtaattcttcatatacatcctgatactgatacccttccacaggcacatctactgcacttcgcccaaacataatacctgaacagtgatcaaaccatcctgctagttttaattgaacgagcgatctcttcacgcttgcagcatttaattcgcagttttcaaagtaccagagaattggttcatcctttaagaatgttttttgaaaagctttgacgtctccaaaaggcgtccccgctaagtggcgaatgacatcaatacagccgcccatcagtctcccctttaacatcttttcttgtcgatcaaccgtatgccatgcggtcggttctgttaaatgaaaaacatgttcaatcggattgtcaaactgccattccttttgatacattgatgaagaatattggctgatgtccatttccccttttgttgaaagtacttcttcccacatgacagtcgtttgatcaagctcttctccctgaagatctactagattcggcccatgcgcagtagcaatacctgttttgaatgtcaacgcgagcaggagagcactagtatctgaataaccaagaatccactttttttgcatcgatgagaaatcaaggtgctctagcacttccattaaaagctgccctccccatggcgggatgatatgatcaatctcatcacatgtcatcatgtactgaagctcctttgctcgttctacggcaggggcagatttcgccttttcctgcttccagaccgtctctccacatatgacatcatagcctctttttttcattcgttcgcatgagagctgaaacatgtcatgcaatgatggctgtacatctgaggaaggtgctgtgacaccaatcgtttgtcctttttgtaattgtggaaattgtatcatcctagttccctccatcctctctcaatctctcatttataaagaagatgcccctattacaagggacatcttcttttattccttttgacgcagtacagtatagacacctgcaaagatacatagaatgccaatgaatgagcgtaatcccatttcttctcccaaaagcatccagcccagaacggcacctacgatcggttgaaagaaaaagaacaaaccgccgcttgaggcatccattaattgaagccctctattccataaaaagaatgctagagctgttgagatgatgcctagatatagaataccgccccaaatctcaggccttgctacctgttccacatctaggtgaggtaaacgaaataatacaggcggtgttaaaacaatgaatgcaatgatgatcgcatatgtggttgtcaccacctgagggtactttcctggaacacgtttgagcaaaacagacatcagcgcccatgttaaagcagcgaagatcaatgaaagaccaccaacaaattcatctgtctgtactgcaactggtccaatcatgagccatacacctgctgtagcaagcaggatggatgcgcactttcgaacagtcatggcttcttttaatagaaagaaagcaaacagcaccataaacgcaggagttgcagatgtaataacagcccccatttgtgcagaggtatacatcgtccctatttcttgggtcacgattgaaaggaaatttccgatcagcccaatcaacaccataagcgggatatcttttttatctaatcgaaaggaatagcccaagcgccaaatggtgaacaccaaaacgactcctgctacagcatatctcatccagacgagctcaagtggcgggacaaccgctactgttactttgacaaccacgtacatgccgccccaaatacttgctgcgattgctaggtaaagggcgcctatatatttttcattcatcattttccctccgttattggatattttgagtaccatatccacaaacggagatcactctccgttatggacggagggcatttggaacatcatgttcaaacaaaggtttccacagcatttgtcgtcactccaattatttttattttctgatactttataacaaattctggttgacttcaatcctttttgcaccttttttcttcatataatagaagataagcggctattgacatgctaaattcgttttcatatagtaagtaaaactataggtggccacgcagaaaaggagtagaggtcgttggatattgaagctagaaaacagattcccaccacggaacatgaaccatttctcgagggaataaaagattgtgtgccaaccctgcttggttatatgagtatagggtttgcctttggaattgttggaattagcgcacagttgagcttatgggacattgcgcttctatcaatccttatttacgcaggtgcttcacagtttattatctgcgcactgcttgttacggggagtcccctttccgctattattctcactacatttattgtgaatctgcgtcatttattgctaagcctgacgctggctcctcattttacacgctactctttaaaacaaaatattggattcggtctattgctgactgatgaatcctttggcgtagccatgaataaattagctcagcatggaaagctgaataaccggtggatgcacgggctgaacataacggcttatttatgctggattgctgcctgtgtacttggcggcatttttggacactggatttcaaatcctgaagcacttggtcttgattttgctctttccgctatgtttgctgcactgctggttctttctttgcaaactgtgcctaaaagtaagttaacccatcgcctgtcacttgttttgtatatggtcgttgcaatgtttctcctgcttcattttgttccctcacacgtggctgttctgttagccaccatgattgtcgcaaccattggggtggtgacagataaatgatcagcagttttatgatgtggctcattctcggctgtatgattgtcaccgttattccaagggtcgttccctttatatttgtacgaagtatcgagctgcctgaagtgatgcttaaatggttatcgtttattccgatttgtatctttacggctttgattgcagagcatttgttcattcatactacaacgggcgttaccattcactggatgtaccttgctgtcttggttccgaccgtcgtaatcgctgtttggacaaagagcttgtcacttactgttcttgtaggcgtcatgctgatggggactgccagatggtttttctaaaagaaaaagcttaaccgcatgtggttaagctttgtttcattctacgattccgtatacaaatccatcgtaacccttttcaccaacagtttgaatggctgtagcctctattcttgactcttgtttgagtaaattgaaaaattcacgagttccttgcactcgctcatccccatcagagtcatgaaggactgctccatttctgacgacattgtctgcaataatgactgttccctttttcgagaagtgtaacgcccactttagataattcgggttgttcggtttatctgcatcaatgaaaatcaaatcgaatggaagcacagccctctcttttaactgagatagcgtatccaatgcctttccttgcaaaatgctcactcgttccgataagcccgctctgctgatgttttgctgcgcaatctgtacatggtggctgacagcctctaatgtgatgagttctccatcctcttcaagagcacgcgccaaccaaatggtactgtatccaccgagtgtcccgatctctaaaatgcgctttgcattcttggtttttgctaataaatatagcattttcccttgagctggtgacacatcaatttctggcaggcctgcttgcttattatgagtaagagcttgctccaaaacatcatctttaggaatcaacttgtctgtgatatactcgtcaactttctcccacacttgcttcatctcatccatctcccttgatcatgtcttctgttttcagtctacatgatgatagcgagcgcgtataatcaattcttttcacacatctattcattttattgatgaaagacatgtcatgatggagacatgaagcagtatcatgttttcgaatttactcgttcaggtgatttttcaaatccccttttttatcttgaagctttcctttggcttgatccttcttcccttctgctttcaggttttgatgatctgttgcttcgccaagcttctctttcaattgacctttggcttgatttgtttttcctttcgctttatccatatgtcctttttcttcactcatttgttccacctccacgtttgatactattcatttagcctttttcacagatacaaaacatctgaatgtgcgatccaagaaactacagcaacataaaaatccagccaaggtcggctggattaaaaaataatgatctataagatagacttaaaagctttaacctgttttactctgatcgtactcgaccagatcacctagaatttcgtcaatttgatttatcatctcagtttcaattttcacctcagatgctaaagcattctccctcacctgttctggactagaagcaccgataattgctgcagaaacgttctgattttgcagtacccatgctatcgcaagctgagcgagagtaagatcaacctcttgtgcgacgggcttaagcttttggatcgcctctaaggtgttattattcatccagcgttgatcaaggtttttaaaaaaaggttttccagcagttgagttagcacgcgaattagtcggaagtgattttcctgggagatactttccagtgaggattccctgggccaaaggcgaccatactatctggccaagtccttcacgctggcaggtcggtattacatcactttcaatgattctccataacatggagtattgaggttggctggcgattagggggacatttagctctcgtgcaagcgctgcccctcgagtaatttgttctgctgtccactcacttacaccaatatagttcactttaccctgtcttactagatctgcgaaagctaacatcgtttcttccagaggtgtagttggatcaaacctgtgtgcatagtaaatatcaatataatccgtttgtaaacgccgcaaagaggcatgacagttttccaaaatatgcttgcgtgataatcctctatcgtttttcccagtaccggttggatgacatacttttgtacatagttcaatgctctcccgacgaatcccttttaaagacctgcctagtatctcttcagccttggtgtctgaataaacatcggcagtatcaaacgtcgtaatacccacatcaagagcagctttcacacaatcatgggcagtttcctcatttatcttaccaccatgattaatccaatttccgtatgcgagtttactaattgttaatccactatttccaagtttactatactccataacaatgtcctcctttgaaagaatactttcattataaaaaaagggtattaatatgtataatatatatattcagataattatatatatattttatataattaaaatatttccattaaaaaagcgcaaaactgtttgataacaatcctttgaaatcattttacacaataagcaagtatgaaataggggggcttaaaaatggatctgagacaaatacgttattttataatggttgctgaagaactaaattttagccgggcagctgaacgtcttaaaatggcacagcctccattaagtcaagaaatccgaaaattagaagaagagttaggtgttacgctttttcatagaacgagaagacaggttgaactttcagatgcggggagagtatttttagaagaagcccgccgtacgctccttcaagtagatagaacgattagcgcaacacaacttgcagatgacggaagaataggtcatttaacgatcggtttcgttgattctactgatattgtgattgatattattaaaaggtttcgagaaagtttccctaatatccatcttgtcttatgtgaaatggctacagaacagcagttaaaggcactatataagaaagaaattcaaattggatttattcgttctaaccaaaataataagatacttacctcagaaatttgttgtgaggaatcattaagcttggttttgccagaaaatcatcctttagcttcattttccaaagttccaattcatttattagccaatgaaccatttatcatgtttccacgtcatctaggtgcagcattttatgatttaattatcagctacttttgggaaaatagcataagtttaaacgtagttcaggaagctattcaaatgcatacgattgtgaatttagttgctgcaggaatgggaatctctgtcgtcccatcctcagtagaaagcgtaaaacgctcaggggttgtttatagaaaaatccaagaaactacgccaaaagtaaatttatatgtttcatggagacaagatgaaacgtcaaccgtcgctgagcactttttaacagttgtgagagaagcttatttaagttctcagtctaaatcatgagaatccagccaaagccagctggattaaaaaattatgatctataagacaggctttcctgatatgtacacgtttcaggtatgatagacataacgaaaagaaaggttggtgttctatgattatcgctgaaaacttattcaccgttcgtgacttgacctactgtattcggtctgctgcaatcggcgatgccaagcagttatcagcgctcagactgaaaattgatggtgaaacagaatatttagaccgtgaaccaggcgaagcctttcttcatgaaaaagattttgaggtgttgattcaagaggataccaaacaaagcaggcatttatttttggtcgctgatattgaaggagaaattgttggtttctccagatgtgaaggacattcactcaaacgctctgctcacaaagtgacttttggcgtcgccattcaaaaggatgcttggggctatcacattggcaaagagctattagccgcttctattgactgggctgatcagcaaggcatccagaagatgtcacttcaagtgctggaaacgaaccaaaaagccattcgcttatatgagcaccatggctttctgattgaagggatattaaaaaatgataaacgtctggcagatggactttattacaatactgttgtgatgggcaggcagcggccaagcttctgacaccttacatcacatagccccataccattgaaaccgcactgtatatcagaagcaaccccatgacatactggaacggtctttcgtaagcagtcaaaaagcgcttatacaaagagccaaataagctccagctgaatgtaccgagaaatccaataagtgcgagaatcagcgtccatatgacatactgcatatgagattgtccatatggcaaaacaaatgttgaaatcacagtcaatccatacaagatcgcttttggattgataaattgcagcatcataccagggacaaaatgattgtaacgatcaagtgtttcgtcatccccgcctttacttttcatgattttgaccgctaaataaatcatgtatgcagccccgatgaacgccatgacccagcctattttcggcatcacttgataaagtatgatattaaagaagcaactcaaacacaaaataacgagaaatccaatacccacacctaaacaaaatcgaaatgtttgcttgaccccatatttattcgtaaagaccatggccatgatgttatttggccctggggtaaagctgctcacaaaagcatagatcaacatagaaagaatcatagttgccgcctcccttatacgttattaagactttaattactttattgcgtatgttacgctttattgtaacgtttggtctttataaagtaaatagagaaaggagtttttttcatggaagatgtacaatcgattatttctaaaaatgtgaggcttcttagagaccaaaagaaattaagcctcgaaaagatggcagaattaactggtgtcagcaaaaccatgattggacaaattgaaagaggagaatcaacccccaccattacgactttgtggaaaatcgccaacggattaaaggtatcttttagtgagctcattcatgcaccacagcctgaaatcaaagtagtacgcaatgaggatgcacagattttaacggaagatgatgggcgatatcgcgtgtatacgacttttccttttgatgaccgagggaaatttgaagtgtaccgagtagaaattgatcctggcgggtcgctgcatgcaaatgaacacattggcgggacagaggaattgattaccgtttttgagggagcgcttgatatatccattggagatgaacagtacagcttaaaagctggcgactccattcgttttaaagcagaccgtacgcatacgtataaacaaaccggagagcaaatggtccggctgcaaatgattctttattatcctcaataaaaaagctgacaggcttgtccacctgtcagcttttcgtttatttaattaaatcccggatcacgtacaaccgttccagtatatgtgactctgtatttgcctaatcctaattcttcaatagacgattgttttaaaataccgacccagccatcctttgcatatgtaatacttgatgggatgttcgatgtcgtatacgttcttgtttctgagacagttcgacttgcctgaaccgttatttcactttttgtttgttcctttgcttccaccggagcagttgtgaccccagcacccgttaagacaattgctccaaccaaaacagaagacatgacctttttcataaaaaatccctccctttttttgttgaacatattaaccataccataatttagttcttttataagttattttttcacttttttgaaaattatgatatgattgtcttatgttggatagagagtgttctatacttctatgcttttatcctcatctcattccgtcaaacaattgtgaacggaggtgatttcatgaaaaaatggctcatctgttttcaacttgttttcctcttcaccttgacgaccacaccacttgcttctgctgcttcatgtcctacagtgaaaccttgtgtcattgatccttaagcatcaaaaaggtcgatcaagcctattcacttgatcgacctttttcgttatgcttgctctgcttcccagcgggcaacctcttctcttactttaggagcgacttcttttccaaataactcaatggcttttaatacttgatcatgcggcattgaaccaaccggtacatgaagcataaaacgcgtgattcctacattttttctaaggtgaatcactttctctgccactgcatctggatctcctacatacagcgcgccttctaacgttctcgctgcatcaaatgtagaacgagtatatggaccccagcctctctctcttgctaacgtgttcatcacatgctgtgtggaagggaagaattggtctgctgcaagatctgtttcttgtgcaacaaatccatgcgaatgggatgctacggttaatttctctgggtcgtgtccagcgtgtactgccgcttgcttgtacagctgaacaagtggtgcgaactgtctaggacttccgccaataatggcaagtactaaaggcaatcccaataatccagcacgtacgacagattcacggtttcccccactgccgatccaaattggaagcggatcttgaacaggtcttggatatacgccgacatcttgaatagccgggcgatgctttccgctccatgtgacacgctcggactgctgtaatttgagcagcaaatcaagcttttcttcaaataattcttcataatcattcagatcatagccaaacagtgggaatgattcaataaatgagccacgacctgccatgatctctgcacgtccgtttgatagtccatctaatgtggcaaaatcctgaaagacacgaacaggatctgctgaggaaagaactgtcactgcacttgtcaggcggatattctttgtctgtgttgccgcagccgctaagacgacagcgggattcgatgcagcgaaatcttgtcgatgatgctcacctacaccaaatacatcaagaccgacttgatctgctaaaataatttcttccactacttctcgaatacgctgtgcgtgactgactgtttttcctgtttgaaaatcaggtgttgtttctacaaatgtactaatccctagttccatgagtggaaccccctatcttataagtatgttacgaattcagagactggctttctgtagcccctcacttgtctgctctctactttttcttttccgagtgtgatcattaatacaggaaccaaatccgattcgatgtttaacacctttttcatgacatcagggtcaaaaccgatcattgggcacgtatcccagcccttgtttttggcggcaagcataaatagcatcgcagataatgaagcattgcggattgcctcttctttctgaaaatccgcccctctcttttcataaaagctcatcgtctctctgaccatttcttcgtattgctgcttgtttaaaatgccaagcattttcagaccttcatagatgttccccgcttgctgataagccttcgggtctcccagtacaataatcgctgctgaggcggaatgcactttatattgtccaaacgcggcttctcttacttgttctttaagaccttctgtttggacgacgacatattgtgtgtgctgtaagttaaaagcagatggtgccattttgacttcttcaaatatactgttaagttcttctctcgaaatcgagatattcggcaaaaaatttgatgcagatcgtctttcacgtaccaatgtatcaaagctgagtgtcatcttgtttccccttttcgtgaagttgttttgcacctaaaccgactttttttagtaattcaatgagctgttctttttcttctttttcaataaaggataggttttgtgaaatgacatctgtgtgcttaggaaaaatgtcgtcaaacaattgcttccctttttccgtcagcaatacatgaaatacacgtttatcagagggggcacattgccttttcacaagcccttgtttttctagtttgttcacgacataagtcatgcttccacttgggattgacaggatgtcgctgattttttggacgggatgcggccccttactatagagcaattcaaggatctgaaagttttcaaatccgatatcataacgttcaatgtctctttgaatatttgtaaaaagagcttgataggctttcatccatacgcggaatagccttaagtctaattcatgttcatgctgcaccatggcaactactcctttttcaagaaatcctaaaactaggataaatttatcctaacactaggatattttattgtcaacgagtttgtttcataaaaaaaagaccacctcatgtcagtgatcctcttcttttaagacaaaatgcatttcagctatctgcttatattgtcgtacttcttttaatgaaaacttggattccatatccgatggggaaaacagaggaatgcctctcccaatcatgacaggtacgatttgaaggtaaagctcatcaaccaatccttctcttatgaaagactgaagcagctccccgccgcctacaatccagatatgctgacctgtttcattttttaattttttcacaaatgataggatatcttcgcgaatgatgtgagttcctttcagactgtcttgtaaagtacgtgacatgatataacaagtctttccttcataaggaaactcatctggtgacagctgaagaacctgttcatatgtattgcgccccatgatcagcgtatcgactgacgcataaaagtcatcatagttcgtatcttcttcgccctccgtccctattaaccaatcgagccgatgatcctctctcgctaaatagccatcgatactcattgccccataaaaaagcagcttccttttctgactcaatctcatcactcctcacctgaataagtacatacgttctatattgattgtatcagaaaggaaagacaaatactatatggctttctcccttttatgattcatgctccactttgacgagaagctcatataatttgtgcgctagctttccggcatcaattaacatgtcttcatgaatccattcttcaagtacgccaacaacaccagacacgacaaaagaagcttcaatttgttctttctctgtaatgggccgctctacaagctgccactctttcatgattttttctttaaaaaacgctttgaattggttggtcgttggaccatttggttttacaaataacgtcaacatatattgattctctttcaagtactctgtcgttttgtttaaaaaggaaagcatatcaagagggtcttgactcggaaaggtttcatcatataacccgccaagctgatcgaatagttctttctccagctgttcgtataaatcaaacacatcttgatagtgcaagtaaaaggttccccggcctaaatctgctttccttgagagctctgataccgttatttgctgcacttctttttcttttaatagctcaagaaagctttcccgaatggctctttttgttttgattgttcgtctatcctgcatgagataccctccatttttgaacaatcaggcacacgctgtctatttatgaacaggtcatcattcattgccgatgttcgtattgtttacttcttattataatcaacacatgttcaataatctatatctgttcaaaaaaggaggaccagcacatggttcatttcagacttgctagagaggacgaactgccggaagtggcagatctgttagaagattcgtttcgggattattcattttttgatttattatgtgaaaaggtatcaaagcgctctgctttcgctcgcgagctgcatttggttaacacaaaggtttatttccagcatcaaatctgtttagtcggagtgaagaacggtcatattgtgtctgccgctctgttaaagcatccacgtcttcctgaaccaggtctcatggattatgtgttgtcaggcgggttaaagctcctcttcactggcggtataccggcaattcagcatgtgtttcgtatgttaaaggaggccaaaaaagcgtgttcttccttaaagaagcctttttggtatttagaagcacttgtcgtcgcaaaaaaccagcaaggaaaaaaacttggaagccgtatgttaaagcaatgtctttttccctttatcgcccgacaaggcggcggcctgttcacgctgattacacacaatgaagcgaaccgtcatttctaccgaaaaaatggatgggtggagtttgatgaaagggtattgcgcggaaaagaaatgtccatacaaagctggagttataaaaccgtgattcaataaggtatcctcttcagggaatgatataataaaatcagttcaatcaatgatcatacttggaggagagactgatgatacgacgacttgatcatatcgtgttgactgtacaacatatagaggacaccattcgcttttatacaaacgtattaggaatgaaggaagaaacctttggagaaggccgtaaagcgcttcgttttggtttacagatgatcaatcttcatgaagctggtcatgaagaggagcgggcagcggctcatccacttccaggctctagtgatttgtgctttatcaccgatttagatatggaccgtttgctgctgcatcttcgcaagctagtgattcctattgaagagggaccagtcaggcgcacaggcacattaggtccggttgaatctgtttttatccgtgatcctgatctgaatttaattgaaatatctcgatatatagaggagggtgatccctcatgacccgcttatttttgagaccgattgaagaacaggattatccggggattcaaagaggatgccagcatgcagaaacactttacatgactggcacacgaaaaatgttcacactagaagaaattcgttcagcctacacccgatttttacaagatgatagcaggcgagatttcgccatttgtctgttagacacgcaagaaatgattggggatgcggcgattgtggatattgatccaatcaatcatacggcaagcttccgcattgcgcttcatgggccagaacatttccaaaaaggctatggcactgaagctgtccgaatggttcaagcattcgcctttgatacgttagaactcaaccgtcttgagctcgaagtcttttcccacaatccgagagcctttagaagctatgagaaagcaggatttcaatatgaaggaaaaaggcgccaagcactctatttcaacggtacctactcagatgtcatcatcatgggcatccttcgtgaagaatacaatcagatgaacagtggagatgcccctgcttaagaaaggacatcttttttaaaaaattgaatcactgtggcgatgatcaaacaaatcatggaagagagaacgatagagacgctggatatactaagcgccatgccttcccatctgccaatgaagaaactggatattaataaaaccaatccaaatagaatgaagcatatagggaggatcagccccgcatgacggcttctacctcttttccctgcccaccatgagagacacaatacaacaattgtaaaaatagcggtttgcagccaaaacatattgtttcaactcactttctcttttttattttatgacgatggaggtacttccaatgaacattagacccattgagcaaaaagacaacccgtatatcgcagcaattatccgtcagtcactagaatcggcgaatctggcgatagaaggaacagcctacactgatcctcatcttgaccagctgttcgaatactatcaatcattgactcatgcagcctattggattgctgaagagaatggcgatattgtgggcggcgtaggcattgctccatttacaaatggcatatgtgaattacaaaagctttatttgagtccaaaggcacaaggaaaaggtgcgggcaaaaaactgatggatacagcgctgcaatatgcctctacatcctatgaagcatgttatttagaaacccgccgagaattaactgcggctacaggcctttatcagcgatatggcttttctcttctctcagagccgattgaaggctctgagcattctgcaatggatgcttggtatctcaaaacattcgcatcatgagctgtaaaacaatcgataggtttttgtccgctggaaacctagcttttctgctaatttgattgaagttaggtgttggacatcgcaatcccaatgcggtgtcctcttattttcaaggcaactcctgatcatatgctgacatgccagctgcgctcatgttctttccttccattatatataaagctcaggacatgcagtgactcattgcaacaaataaaattctttatcattcgctttcttctattgctatgctcattgtgaaaggaggtttatgaatgaggctttgttttatttagaatcaagaaaagattgtgacataagtaaacgtcatcaaccatccacatcgcacaggcattaaatcacctgaagccgcagtcttaaaaaaagagacctcgtttaaaaggtctcttacttcttcattcattattctgctgctatctcttctgtcgccttccccttccaaatcagaggtaagcctacctgcgaataaaaatgggacatgtatatttttatgccgccaagcgcccgtgtcaaagatcgtaccattacttatgtaggcagagttcatttccctacacatattgaaaccgcattggaagagataataaatcacttgacgctgaaacttaacagagcaatgtttcttgtcatcatctcatatgatcattcgctctctctaaaaatggatcatccctaattctactgctgctttaattgcttccgctcttgaagtgacctccagcttttgataaatatttgttaaatgagctttgacagttctctcggaaatccccatatcaaatgcaatttccttacttcgaaatcctctagccactgcttgcaagacaagcatctctttttcagtcagcatgtttaattcttttttcaaatggtttggagtcacttgatgctctgttgattcaaataccttagctgcgacgtttgcttgaagaagaatatctcctctgatagctgcttcaattgtataaaataaattttccctgctggcatcctttaaaagatagccctttgctccaagttgcagcccttcaatcattaatttctcttcgttataggtagtgagaatgaggaccggtacttttaactgaagagactgcatctcttttagcatctcaagcccactcatgttaggcatgttgaggtcaagtaatacaaggtctggagccttctctttcaagacatctaatccctttgccccatcctctgcttcaccaacaacatcaaatcgttgatctgtctcaagaattaattttaacccttctctaacaacaaaatgatcatcgacaatcacaatttgataagacattgtttttactcctttttcaaaggtatcgttaccgtcacttgtgtaccttcatttttttcactttttaagcgcagctgtgcatcaagcagtcgggcacgttctgacataccaattagaccgtaatgccccgaagtggattcttgttttttctcatcaaaacccactccattgtctgtgatttgcaaggagatgtgatcacctttttgctccatcatcaattcgaccttacttgctttggcatgcttggcaatattcgtcaaacattcactgacaatgtatacggtatgttcgatgagaaaaggggacacttgatatgagacagccatttttgtatgaactggaatattcgtcgccgtcataaagcgcttcacttcatctttcacagaatcagctaggtcatattgatcctggctatatgttcgaagatcgtcgatgaccaatctcgcctcagctaatgttgtccgcgcatggctcatagaacctttaataatgctttgagcacgctcaacattctgattctctaaatgtgcatggaccgcttctaactgcataataatacctgccagtccttgtgcaagggtatcatgtaaatctctcgccattctttgacgctcatttgtaagtgtcagctcttccacttgttgatgtgccaattcaagttcctttaaaaatgtttgtgtacggattctagctttgacttgtctaaaaaataaaatggagtatgcgatgactacaatcagaatcaaaaacaaaataggaatgtataccgtcaaatcatctgtatcattaaccaaaataagggcaagaaaaaaaagaacataaaaactaagccctgtcaaaatcaccttcaatgtatgataatataccccaatactttgcgcaattagtactggtaacagaccaattaagatcacaggggtagccgcctgcatgactgaaacacaaagtagaatcacaattccttgaatcagaaaatatacccatggattctgctgaaaccagtaaaatgaccaccaatggagaatcagatgtatggcaataagtgcagaaaaaaacaggctggaaattgctaatggggtggttataaactgaaatatcattgctgcaatataaacaagaacgacccataataatgttggaatccgtgaatagatcatttcattaaaagggtctacccgtcgtttcgccataaataatcaccatccgagcctcatattcactcaaaaaataccgcccaccctttatcgaggtaatggcggtatcatcaatcataccatgtaagattatcagtgactaaatcactttctcttctttctcttctttctgagaaatagactcaccttcaatgtctatacgtggaagccacctttcgaaccatttgggtaagtaccaagcagctcgtccgatcagcatcatacacgctgggataaaagtcattcttatgacaaatgcatcaaacagaacgccaaatgccaacgttaatcccattgttttaatgatcaagtcatctgcaaagataaaactagcaaagacgagaatcatgattaagcccgcggcagtcactactcttccactgtgcttcaaacctgatacaacggactttttcgcatcacctgatagaaggaaatcttctctcattcgactgactaaaaagacctcataatccattgcaagaccaaataatattcctgtcactagtacaggcataaagtttaacaatgggccatttgctggtattccaaacaatgacgcaaggtgtccatcctgtaaaacaaagactgaaaaacctagtgtagcggtcaatgtcataaggaatcctaaaaccgcttttaatggaacaaggaatgatctaaacacaagaatcatcaaaatcaaagcaaatccaataatgactcctgcaaatttcggtaacgcttcactgagtctatctgaaatatctatattaactgccgtagaaccagtaacaagtaatttcgtatcatactttgcagcagtctgactagattcatttcgtatatctttgactaattgctttgtcgccttatcttctggaccgcttttcggtaagatggtcagcatggcgtacttacccgatggattaggaacagccggtgccatttgtttgatgccatccatcttctctaatacttgtgttgttttctcaatagatttcgttgcgttatttgtatgggaggcatcaatgataacaaccagtggtccattaaaccctttgccaaacccttctgctaacaggtcatagcctttgcgttcagttgtttccttccctttcatgccgttatcaggaagacccaactccatatgaagtgctggccaactgagtagacccgtcaatataatgacacctaggatgatcttacctggatacttcttgataaaccttccccaagctgcttgttcttctttttgttgagattgtaatttagagaaccatttattctttcttgaagggcttactttatcaccaagaatccctagtatcgcaggaacaattgtcagagacacaagcataactgatagtaccatgaatgcagctacaagacccataacgcctaaaaatggtataccgactaatacaagtccgcatagtgcaatcacgacggtgacacctgcaaacaatacagcactgcctgctgtagcaacagctctagcagctgcttctttcaattcgtaaccctctgctaatagctgtcgatatcgagaaatgataaataatgcataatcaattcctacggcaagtccaatcatcacagctaatgtaagactaaatgcagacatatcaacaaaatttgaggtaattaatatgaccatcacgccgattattaacccaatgacagccgtcaagatcggtagtcctgcaatcaatagtgaagcgaaggtaaaggctaaaataaagaaggccatgacaatacctatgacttccgaaatcccgccaacctcaatttctgagaatgtgacggagccgcctaattctgtttggatgccagcctttcttgaaatcttaatactatctaatactttctcttttgaggatgtttttacctcatccgcctttacccggtatgtaatatccgcataccctattttcttatccttactaatagcaaatgtctgatataaatccgtcacttgcttgactgctttatcctttttgacttctttgatcgtttcgttcaatttgtttcttactttttttgtttctaatgtttcacccttaggtgctttaaaaatcagacgaatcgtcccgccatcatcacctgctgggaactttttctccaagagatccattgccttttctgactttgtacctggaatcgacatatctccattaaatgaaacacctgtccctattgttgtcgccacaacagctactaaaacaagtaaccaaccgataatcatccgtttcggcttagaaaaagcactttttcctaaatgatataaaaattttgccattcacttactcctttttcttcaacttcgtgaacttcatctttttattctaagcaatgagatgatcgattgaaattgtactttcgggcaagaagcattgtacttttaggcaacaaaaaaagggcatcttcttaagatcccctttaaatcgtttatgaggcgactgttttttgcctcgttctgttgattttaccgacaaacatatagccatatttataatgatttgctaaccgtgacaataggataggtccagcaattgcaagtgctgatattatgaatatccccacaaagaatggataatcatttaattggccccatagcaacacagagatacctagaaaatacccgtgaagcaaatagatggtgaatgaatattgactaatgacagctacaaaaggtggaacgcttttcactttagaaaacaagagaaaacataagaagacaatactgactgtataaagaacaacgtctggcctcttagaagaaggctcgaaaaaacctacatatgaattgcttagaagggtcgcggctgaaatcaaaacaagtccatacacggcatacttaaaacgatgaagtcttgtgataaactgctgataattcgctccacaataataggctaaacaaaaatagaataaccaacctggaaatggaatccattctaagccgaacattggattaggtaattgaggttgtgggattttgacgaggttcatgacacttaaataaccaactgtgatgataaaggagatcggcaatacccatttggctgaggtacgcttagccattttgtgaaaaaacatgtgcaaaaagtaaaattgaaaaataatcagaacaaaatatccaatataatttcccaataagacatttgctgaagctcttttaaagaaatcagctgctcctccatttaacgatgccgaatgcaaaaacccatcgacaatcccaataaatgcaaatgggaaaaagatggctttcactctcttccacataaatcctttgggtgtaccatttggataagaatgcgccaataaaaactcagaaatgaaaataaaactcggtgtactgaacatgagtagtgctacaagaatagatgatgaatgggggctagataaaatggctattgcatgaatgagcacaacactcaaacacgagatacatcgaatataaaaaatctctttaatttgcattgaaaatcctcctctagtattttggtaaaatattcatcatattaacatgaataacacctcatcaacagagaccttgtgattatttcaatactttatccacaggaacaaaaaaaagagcccttgttagagcccttaatcagatgcaaccgtcgccttccccttccaaataaaggttaatcctaatcctagaaataagacaacacctgcgaatagaaatgggaaatgtatatttagatcgaataaaatcccgccaagggctgggccaaatatcgtacctagacttgtgtaggtggaattcatccctgcgacaaatccttgctgattgccagcgatttttgataagaaggtcgttaatgctggacgcaataaatcaaatgctaagaaaattacacatgtgacaatgagcaccaccataaaacctgacacgacagttgagacaaaagcgagcaccgctccaacaatcaagcagagctgaatgactcttttttccccaagggtattaacgagtttcccaaacaccagcacttggatgataaccgccacaatcgagctgaccgtaataatcaccgcaatatcttttggaccaaatccaaacttatgatttgtaaacaggctgaagaccgtttcatacgcagacagtccaaacgcgaggacaaacacaatgataaaagcgatgagatagcttggatggatcgattttttcaaatctttaaagaaggtcgattccttcacttgatccatctgcttcgctcgctcttcttttgttaatggctccttcagcaaaaacatagacgaaatgacggctataaaggcaatccctgctgcaaagaagaatggcaggcgtacaccgtattctgcaataaatccgccaatcccaggaccgataataaagccggtactaatggccgctgatacatatcccattgcctttgatctttcttgaacggtcgtgatatctgcgacataagcagtgacagcaggcataataaatgccgcactaatacctcctagcagccttgcaaaatacagcacatacacgtgtgtcccaagaccgaagacgagttctgataatgcaaatagaaaaaggcctgacacaatcataatctttcttccgtagcggtctacccatctccctgcaataggtgatgtaatgagctgagccacagcaaacgccgccacaaggtatcccatcgtactccccgtcagatgcatcacattcatgaatagcggcatgacaggaatgatgagaccgatgcctaaaaaggcaataaatatgttacttaataaaataacgagtacagctttttgctcacgaatcggtttttgcatgatgtttgtttcccctttattgattcaattgttactcatgatgattgattccgtgaataatcaatgagatcgcttgtttttgtaattcttttttctcttcgattggatcatttttatacaacacgtctaatccgtaaaaaacggataataatattttcactgttgactcgacatgctggatcgaccagctgccatcttcgttaccttcaagtatgatgtctctcatcacatcatcaaagtctgcatcaatcttgttcagccgttccatgacctcggcggatgtaaaggcacttgcacaaaattcctcacttgctctcattaatgggtaattaatgcccatttgactgagcagttctgcaaatcctgcgagctgatcaatggcctggtgcatcgtttgtttttcctgatgccacgtctccatcatcaagaggtgatcctcttccatgatatgaaggaacaaaaactcttttcctttaaaatggtgatagagattacctttactcacctcagccgcctctagaatatctcgcacagaagtttctgagtaccccttttttgcaaataaatcacgtgaagcggtgacgatttttcgcttcgtcttctcgctcttttcagccccgctttgtgtacttgtcatcttttacaatcccttctaccttgcttttcttcattaaaacaaatcaaaaccgaccagttggtttattttttttattataaatggatttttttcgaaatacaataaaaaagtcatcgaaacgatcacttgtaccacccctcatttaacatttcttaatatttaacttcacttaactataaacattgcctataatgaaatagaggtgatgtcattggatgaggaaatcattcattacagtaaaaaaatcattgaatactcgaatgcactaggctccatctatgtagaagagtatcaacgatttttaaaacatgaatatgcagatttatcagccaaacaagagctgacacttgaattattacggacaaaaacaagaaccatcaacgaactagctgattacttttccatttcggcaagtgccgctagccagcttgtatcaaagctagaacagcttggctatgtcaaacgagaaataaatccacataaccggcgggaaatcattgttgattttgctcaaaagggtcatgactttcacaagaatacagaagaaattcaattgcacctcattcaaaaatactatgcaaagcttcaaaaagaagatttaaaaacattattgtctctatacgaaaaaatctatcagattgcgaaagaagcgccttgatctggtgtttctttctccaacatttaagttaattaaactattaaggagatgaaaatatggatagcattcatttacaagatggacgtcatattggtttgtgtgaatacggggatcttgaaggatttccagtattcttttttcacggaacccctggatcaagagtgatgtttttagatgatgacccgatttctaaagagctcggtgttcgtctcatctgtttagacagaccaggatttggtttatctacccctcaacctgaacgcgcgattttagattgggcaaaagatgtgctaaaggtagcagatcatctcggtattcaccatttttcagtgatgggtgtatctggaggcggcgcattcgctgctggctgtgcttatcaattgccgaatcgagttctttcagccgctctgatttcaagtacaacgccatttcaggacggaaaaccgcctaaaagtatgctcaaagaaaacaaattggcttttttcctcagtaagaagttcccttggttattgaaagcaagctaccgttctcagaaaaaaatgattgagaacaaaccggaaaaatttaagaagctggccaaaaatgggaacaaacatttacatccatgggaccgtcaatttcttcaaaccgatgagcaattagagatgatgatgacacatttacacgaagccactcgtcaatcggtggatgaatgtattcgtgaaccagatttgctctcgcgtccgtgggcatttgatatgaaggatatacaaatccctgttgatgtatggcatggaaaagaagattcgatggctccgtttgccgaaatagaaaaaatggcgcctagcattccaaacgtcaaaacctattatatcgatgaagcgggacattttcttacggatgtagacgatatttggcgagatattttactctctttaaaaacacgtgcaaaagggcatcatcaggagcacgcataaaaaagacccgaagcttcgggtccctttcttcattaatacttttcataatatgtctgcactttacttggatcttttgtcttcgttagagcgagcataagcagaatgcgagctttttgtggattcaatgaatctgatgagacaaagtgatgttcatcatccattttttcatgggtcacaatcccattccccgcacggctcgatctcacgaggaccacgtctttcttcacggcatctgttgcccctttgatggcttcagttgacatcgttccattgccggctgcggcaacgactatccctttcgctcctgcttttactgctgcatcatacatgtatttttgatcattttgatagccatataaaatatcgacttgtggtaattccttaatgtttgatacatcaaattcactttctgacgtatgttttctgatcggttcgttataaaaagaaaccacttcaccagtaacttctccaatgtaaccatgttcaagagatttgaaggaatcggttgtcgtcgtgtttgtttttgtaataaatcgagctgatgcaattcggtcatttaatgtgaccatgacacctttgcctttggcttcttttgtggatgcaattttcacagcatgatacaagtttagcgggccatccgcactgatagcagatgctggacgcattgagccaacgactacaactggtttatcacttttgacaaccaaatgtaaaaagtaagcggtctcttcaagagtatctgttccatgtgtgatgacaatcccatcgacttgatcatcgtttaagagtttattcactcgtttggctaattttaaaagaagagcatcatccacattttcactgcctacattcgccacctgctcacctgttacgtttgcaatatccttaagctgaggaactgaggcaatgactttatcgataccaagtgcaccagatttatatcctgtcgtatctgtatcactgtctgagcttccggcaatcgtcccgcctgtcgctaaaaccttaatattagataaggacttattccctgtttctacggctgtcgttttgtccttggattccttagatgcggtttcgtttccgctatgatttttctcttgggtacttgtattggcacaagctgctgtcaacagtaataaaacagaaagaaggacagcacctaaccattttgttacgttcattcgatcatctcttttcttaaatgtgatggatacaaagctaggtctcttactataggatttactttataccattccttcattcatcagcatgaggcgaaagatacagaaccaaataaaggaaaaaaagacatgttcttaattatttatttacatctaaatacctaaattcacttttaaaaaagagaatattgaggttattcaatgaatgacagaaaacgatgctaaatcatcaatttatgataaattatagtaaattttacaaaaaaggagtctatctattacaaatgcttcaatcatttcacaaaatcctaatcacactattccttagttcgattttactcagtctgttcgtatgcttctatccaccgattcagggagtgcctgcgttcatggtattttacgttcccatcttttttgtttgttatttcgtctttgcggttcctttgcagttgttgttttctttgcagttgttgttttctttgcagccaaaggctttccatccactttatcttgctgcttatttactgatcgcaatggttgtcatgctttttgtgatcgatggtattgggagttcagtatctatacctattatcattatgagcagtttgatctactgggtctctgattctttgctttatcaaagaacatatgaaaaaaacggatgaggtcttcttctacatatgctgacacactaatcaatcatgccataaaaaaatcaccgagggcatcttccctcagtgatgtgtcttttctatttcatacttgaacccgcatgtgaaaaaatcggatctttcaattcaaaatcaaaggtcttaccgtcaacaataccgactgttttttcatggtcatacagctcaagcagacaagctgccatttcttttgatgtatgatatttcttgatattgccttcatattcgaattgatctacatctaatgaacgctttgcaaattctgattctgttgcggaaggtgctaatattttcgcctgtaacttagctccctttcctttcaactctagtgccaatccttctgtaaaggcgctcacgtaaaatttcgtggccgaataggtgacggcattgccgacgactgtatagcccgctcttgaagaaatgttgatcagctgagccccttctacttgctcataatcacgaacaaataaagtggataaaatcgttaaggcttcgatatttaggtgaagcatgtccccaattttacttaaatcttgctctccaatcgagccgaaatggccgaaccctgcattattaatgaaggtgtcgagctcatactcagccaatgattcataaaatgtatacacttgctccatgtcggttaaatccacagactgtatgtttactttaatatcgggatattgatcaagaatttctttcttcagttcttggagtttctcgagccggcgggcagctaatataaggtttttgcctcgtgctgcaaaggctagtgccgcctcatatccaatacctgaacttgctcctgtaatgactgtatagcccatttgatatccccctattcactattttgctcgactgtggaacgatgacaatattttatttttcttctgcatcgacaacagctacaccaatttttttattggtaggatcatatattccagaaaattttttatttctatcattatttaaataccctgttacttctattccgccagttggatcaatattatattcatttgagaaatcaatttgttcaatagattgatatccctcttttatatactgttccatatggttctttgcttcaattactaaggtttgttctttatcttttacacgctcattcttatcggattctaacttcataataaatcctccaactgctataataaacaccaatagtataaatatggtttttttcactgaatatcaccctttaatataattctacataaaatgaaaggatttgtatatattttgaaagagactcaaaagcgctcaagtctatcagatgaagagtactttagattaagcggtctagcttataatgataaaacaatttcattacataaagaaataaataagcctttaaaggttaatgaacattcttattggtttatagataaaattgcaaaagatcaagatacaggacttgatgctatagttttagttcaagcaaaaaaaaagaatggtaaatggattaaaacaaatacacctaacaacgttgtcgtagctttcgctggcactgatccaaaaaatcaacttgttcaagatgttataaaagctgatggaggaaacgtagttgcagggctacaaactaaaactacaacaccctatatcgttaaaaacgagactaaagattatactaaaaccatttcgaaatatactggttctccagggcaagaagctatgcttaatagcggtgaatacaaactcatcactaaaacctctcaattcgatcaatctgatcagctcgttaaagaagtaaaaagacagtacgctggtggcaatacagttatatcagctactggtcattcactaggtggagcagaggctgattatgcaggagtgattaacggtgtctattcagttggattcaataatccatctattgtaaagcttcatgacaaagaaactcaacagagaataaaaaatggtgatttcagagcaatgaataagtctatcattaacccagatgacatggttggtactggatggggacttgaatatgagcgacacaatggaacaacgatttatacaaaagatccatctgatgcaagactaaagagacacaaacgtttaaaagctactgctttgtctggtacgcttataccgattgcagccgactttatcatgcaagcacttggaattgatgacacccatgctataagcgagtctaatttcaaatttgatcagaatggtaatatcatcaatatcaatggaagtaaggatgtatataatcgtgacttagaaacaatgacctcttatgctgatatggatggtcaaacaataaaagtaaatcaggctgttgcaaaaagattagctgaacaactgactttagcattagaagagttgaagaacgttaaaaaagaagtagaagcatttccaaaagaacacagtttaacaacttacaatctttcaaatcaatttaagagtaaactagatcaatttgaacaacttgggccaaatgacgtcgatcaagccctattagaaatagctccgtatattgataaaggaacaccacttttttatgataaagaggagcaatacaaatttgaagcttcattgcattatatgattcaggatctagaagagataaccgaattcattgtaaaaatggcagaaaatctcacacaaaaagataaagaattagctagatggctgaggttataggaggtcataattagtgcctgatatgaacgctgaattagaaatgataaaaaaagtgcaacaacaaaatgaactaaaaagacagttaaaagcacaagcaaaaactgatataaactcattaaaatcagatattacaaaagcgacaaaactagcagcatcaacaaaaactattgctcagacatatttaacacttttttcatcatttgaaggtaaatcgcttgatgcattagtggatagactaaatcaaaatgcacaaaaaacattacaggttaagcatgatagaaaagcttttaccaatagcattagaacgaaataaagaaaataatcaaatcacaacagaagtaaaaagcacaggttacccctgtgcttttcctattttgaagagaaaccattatgacattttttcaaacgccttcttcaattgatcactcatcagatgccaagcttcttcagctatttctaaatctccggcatgcgtgaaggcgtgagggactcctttaaactgtctgtacgtgacatctacccctgcttcttttaacttctccgcatattgttcggcttcttgagctagcgaatctctttcagctgtgatcacgagagctggtggcatttgagccaaggatgagcgatcggcaaagattggagaaacgagcggattgtgcggatcttggccttgcagatagaaggcattaaagagcctcgccatttcaacagggatcgcttcttcaaatgctggcttttgtgctggatcagtggctaaatcaagcggcggatagtcaagcacttgatagacaatcgggagttggttccctttttggatatttaagagacaagcagctgttgccaaatttcctcctgcgctatgtccgccaatagctattgctttagggtctatttgaagctcatcagggtgttcatacagccacttcaggacatcgtagcattcatgaagagcggctgggaatggatgctctggggcaagctgatactcgacattgacgacgatacattgcgccctgtctgcaataactggacaccagtggttatccatttcagcactgcctaggataaatcctccgccatgtaaatttacaaaaacgggtagcgtctgctttgatgtgttgaccggcttaaatacccatacctttgtttcgccagcacttgttggaatgtcatattccattttgttcacttcaggaggatgaactggttttagttccgattgactcggtaatgaaccttcagttggttgacgtaaagacgcagcgattttgatttgctcttgtaagttcatgatctcagtctcctatcgtaatcatttcttcttaactcattcgtttctttttcctcttttccttctactgaatcagcggcacattctctttggttcactttttatctatctccccattttcgccctatttgaaacaagcattggacaaataaaaaaagcactgcggcgctaagtcctcagtgcttttcatctattttatgaaacttgctgttctaccttcactcgtttaatgaagaaagcgataattagaccaatgacggtcatgatcacagcaaagataaatgcatgctggacgccatttgtaaaggcgagcagctgattcatcggatttgagggatcagccacattttccataaagctgcgggttcctgatgacaggatggaaataccgaccgcagtaccaatggctcctgacacctgctgcaatgtattcataatcgctgtaccatgcggatatagctctggcggcagctgatttaatccatttgtttgtgcaggcatcatgatcatcgcgattccgaccattaatgtaatatgaagagtcacaatgtacccaatcgatgtatttacacttagattggtaaaacctaacatcgtcgctgcgacgatcgcaagccctggaatcacaagccatttcggtccgaacttatcaaataaaccacccatgattggagatagcagaccgttgataattccacctggcaatagcattaaacctgctgtaaatgtcgtaagtgccaaggatgtttgcaaatacaatggcaaaatcatcatagcagacagcatcaccatcatacacactaagatcagcagtaacccaatgacaaacatcggatatttaaatgggcttaagttcagcatcggttccttcatattcaactgtctgagagagaatacaagaatcccaatgacacctactacaattgccacgatcacatgcatactgctccagccgccgccttcaccggcactactaaagccatacacaattcctccgaaaccaatggttgaaagcacaatcgataagatgtcgattttcggtcttgttggctcagtaatattttgcatgaagataaaaccaaagacgagtgcagctattaatagcggaagtgaaatccagaaaatccaatgccaagtcagcgatttcaaaataagaccagagactgttggaccaacagctggtgcaaacatgatcacaagaccaataatccccatcgatctgcctcgtttatgaggcgggatgatcaccaatatcgtattgaacatcaatggaagaagcaatgctgtaccgactgcctgtacgacacgtgccaccattaaaatactaaagactggcgcaactgctgcgataaaagttccaatgatcgaaaagacgagcgacgtcatgaaaagctgtcttgttgtaaaccattgaagaatgagtcctgaaattggtacgagaataccaagtgttaataaatatcctgttgtcagccactgagctgtcgtcgcttcaattccaaagtctaacgttaagcttctcagcgccatatttagtgccgtttcactaaacaggccaataaaaccggctgtgataaatgagataatgatgggcagcgttcgaatttgagaagctgctgcttgctgtttgttcatagtaggttggctccttttctttttttcaatttaaatcaagcataggaagtgaggacggtcagaaatgagccacttcaatgtctattgaaaacagacaaaatctgtttttctgcagcgaattgagcgattttttcgattgaataaccagattcatgaatataaaacatcagttcaggtgtcatcggagaggacatacaaagtgtcgtcagctcaatatcctgtatgttcgcttcccctttttcatctgcttcttccagcaaatcacgaatcatttgccttagcgattgactgtaatgacagtcatacactttgcttgtctgctctaaattcccagatatcgtaagcatccgaatccagtctaaatgatgaccgacgatgagatgaatttcttcgagcacataacgcaaacgttcacgaaccggctggtcactgattttgctcaagtaaagatgcaaagcagggatcagctgttcaaatctttctccaaggatcgaaaggcacaaatcacttttattggcataacggcggtaaagagtaccctgcccaacaccagctgttttagcaattttatgcatgctgacattttccacaccaaattcctgaaacagagtaaaagcgacctcttcaatttccttcccaatatccttttccatgatgcttcaccttctttaccttcatccatattgcacttctctctatgtgttcaatcaaaactttttggttttcattaggacaattgtaccggtattatcttacggacaactgtccgctttgtcaatcattctttagtaaatagcctgaaaaagatcattttctttcgtaatttcctatgaaaaaaatagaagagtctagtaaaatatcctctttaatatcatatattagaccgattttccatttcgagagaatcatgtatgatcaattaagaaaacgctttcaaaacaagagaggggaatgcctacatgtcttaccgtgtgaaacgaatgttgatgctgcttgtcactggaatcgtcttgagtttgtccacatttactgcgggtgcctcggcccaaacaggcggatcgttttatgagccgtttaacaactataatacgggattatggcaaaaagcagatgggtactcgaatggaaacatgtttaactgtacgtggcgtgcaaacaatgtctccatgacgtcgttaggggaaatgcggttatcgctcacaagtccttcctataataagtttgactgcggagaaaatcgttccactcaaacatatggctacgggctttatgaagtcagcatgaaaccagccaaaaatgttgggatcgtgtcttcgttctttacttatacaggaccgactgatggtacgccttgggatgaaattgacatcgaatttctaggaaaagatacgacaaaggttcagtttaactactataccaatggtgtaggaaatcatgaaaagatcgtcaaccttggttttgatgcagcaaactcttatcacacgtatgcatttgactggcagccaaactcgattaaatggtatgtagacggacaattaaaacatactgccactactcaaatccctcaaaccccaggaaagattatgatgaacctgtggaatggtgcaggtgtcgatgaatggctcggctcctataacggtgttacaccactacacgcgcattatgactgggtgcgttacacaaaaagataaccacattacaaaaacctgtgacttgtcacaggtttttcttcattcacatggaattggtttttagttgatgaacgagcttttgttcataactgtggataatatcttcataactttctatcttgtaatctaaccgcttaatcgtctcttcgatttccttttgcttttctacaagtctttctctctcattgaccaaaatacttttccgcgaggacagggtatgatcctcgccctcgataaataaagccgtatattctcgaagtgcatcaattgaaagacccgcatttctcatacatttgataaattcaatccactgaatatcttcttctgcataatcacgaacaccgttttcatcacgacggatcggtcgaattaatccaatattctcgtagtatctgagcgtagcagtagataaatcgagctgcttggcggcttgtgctattttcattgttttcacccttctcttcttctctcaccttatgaaaaatgaaattccttctttttatcatctccaatttgatagagaacgcaagatgttctttatttaaggatgttgaaaagcctgaagagggttctctattgacttagagttcactttaagacgtacagtatagaagtagaacagaatcttacttttgaaaggatgatccagaatgtgtcagacgcaccaatcaaacgttttaagtgtttcacatgcaaaagcgaattttgaacggacaaccattgaacgaagagcgcttcgtccacatgatattttaattgatattcaatttagcgggatctgtcattcagatatccacagcgcctttgatgaatggggcggcggtattttcccaatggttccgggtcatgagattactggagttgttgcggctgtcggtgatgctgtgacgaaatttcagattggagaccgtgtaggcgttggctgctttgtggattcctgcggcatctgtgaatattgccaaaacggagacgagcaatattgcacgaaaggagtcgtccaaacctataataacctcgattatgacggggaaccgacttatggcggctatagtcagaagattgtcgtgacagaacgctttgtcgtcagcattccagatcaattatcccttgatgccgcaagtcctcttctctgcgctggcatcacaacttattctccgttaaagcactggaaggcaggcccgggtaaaaaagtggccatcgtcgggatgggtgggctcggtcatgtggccattcaattcgcacgtgcacttggcgctgaagtcacagtattgagccgctctatgaataaaaaagaagaagcactgtcatttggtgcaaaagactattttgctacaagtgatcccgatacctttaaaacattagccggccaatatgacctcattctcaatacggtctctgctaatatcaatgtagacgcctatttgtccttacttcgcgtggacggaaccttggtgaatgtcggtgcaccacctgagccagatcagttccatgtcttttcattaatcaccgggcgccgcagcattgctggttcactcgttggcggcatccaagaaacacaagaaatgctcgatttcgcagctgctcacaatatcgcaccacaaattgaagtgattaacgcaagtcaagtggatgaagcgtatgaacgtgtgctgaaaagtgatgtgcgttatcggtttgtgattgatatttcgacattatgatcgaattctatttggaaagaccagcgcaatggctggtcttttttaatggtggatattctgtttttcttgtattgaggattcttgaggatatgttgaaaaatcatccgaattttttatgaaaaaatctctcttttttagaactaaatttattgacaaaaaataaataaacatgttattattaaaaatttgattattttacgtcgaagtgtggtacccttaaagtagatacatgatatggaggcggatgatatgtttcaaattggtgataacattgtttatccaatgcacggagcaggtataattgaagccatagaagaaaaagaattttctgatgaaaaacaacagtattatgtgattaaaatgtcaatcagtcatatgaaagtgatgattccaacacgaaaaatgtctggttcacgtattagacctgttacagatatactggcattaaacaatgtgatgcacattttccagcatggcaaatcagatcaaatactgacatggaaagaacgtcatacaattaatacaaacaaaataaaaacaggtaacatccaagacggtgctgaagttgtacgtgacctaatgcggatgaagaaagagaaagcactaaatgcaagtgaaaagaaaatgctagatgatgcccatgaatttttgctaagtgaattagaagtcatcaaagggattacagaaaagcaaatcaaaagtttctgttaagaactctgccgtcttttgggcatccctcaccatttttgaattcatgttctctacgaaacgacccacccttcaattaatgaaagaaaaaagaatttatttagataaattccgcatattgtaaatccaatatgctatactgttgataaacctttgaagcatgaatttttttacgattaccttgtaacatctccctacttgtacgctgagtagggttttttattgaagaaataaatgaaagcacaaaaaaacaggctctctacagagaacctgttttaaaaaaatgaagattaagcagttttttgaacgttagcagcttgagctccacgagaaccttgctctacgtcaaaagttactttttgaccttcgtctaaagatttgaatccgtcaccttggatagctgagaaatgtacgaatacatcgtctccttcttcacgttcgataaatccaaaacctttttctgcgttaaaccattttactgtaccttgttccatgtttgttgcctcctagtgcgttatcacacaatgtattatactatccttgcccaaagtatcctcaagacgaaaagtctttcttcatgctatcctttacgccgaacaaaaataattattcttattgtaacacgattcggaaataattgcaatttaggatttaaaagagcactaaacgtgatatagtgacacaaataaaacagggatttaatgatgaaacgttcatttagctatgttcaatcctttgtgcataaaatcagtttttttcagcgcgaaaagaaatctttatctaaattctctctaaaatcgactgaacaaagttagtttttccctcggcatatttgtgtttgtcttttttatttaaacttgataggttcagtttgagctgctcgtactcatttctcactaattcgttacttcttaaataatccctgaaatttaactgttcaagtaaatatctattgcctgtttgatacatatggatttggtgtgtacgtggttctcctttcttgaaatagtgtctttcaggtaatacattggttcctctatatgaataaccaagcccttgcaaagctgttacgcactgtgtcccgtcaagaaaatgatctatttcaatcgcaatatcaataatgggttttgcactcaaaccatttattgctgtacttccaatatgatgcacattcaccgtgcactgaccaatgacctctactattcgtttcttttctctttcaaaatctttaccccattcagcagaccaaggaactaaaaaaacttcccctcttggtaatcctagcataggctcaaccccaccttatcatttcgttgtttagttggaaatctcaatagtttgaagcctttcgatcgattagaacgacatttattataagataactcaaacaaagagcccactcacataagatgagtggactttttttagaaactataaaaatcattaatacagccacgaacccgaatcaagaaaacttctatttatacaaaggtgtacaactacatattttccgactcaagtctgtttaaccagttatggactaatgagttaaatacatcaggttgttcaatttgcaggttgtggccagccatatcaagcactgcaaaagttgcccttggatagtcttcaatcagccgccacgcatcttgatatccgactacatcgtcttgacgccctgtgataatgagcgtgggatactgaaattcagctgaaatgtcgaaggtatagccatacccattttgaagaatgttattgatgaattcatgatttgtttgtttagaaggaaggtaaatttcatctcgaaatctttcccattccgtttttccttgcacaactgccatggagcaaaattcatccgtctcctctggagaaagttgtgatatcaagctgctgtcactttttagaacggccttctctggcaagactcttttatcgaatacaggtatagtcattggggccacaagcagtaatccacgaacggtttcccggcgtgaatgaataatacctctagctatgtaccctccatacgaataaccacaaacaataaactgttcatcaggaataatctcgtccaaaagacgcaataccgcttctaacatatcatctgagttctgaatagatggatgcggttcggaacgtcccatccccggtaagtctatgtatattcttttccaaccgctttgtttttcaaataccggttccaatgcatgtaacatcacttgatggtcaagtgtccaaccatgcaatataacaatcggaaatccttctccaatgactttatgataaattgacatgtatttgcatccccttttctagcgcttccctagtaatctcaagattttttgttgtttttcttcatcatagcttaaagtgaataaaatctttgttaggaagctatgctatgattccccaacgaacttctcacgtaaatggattttattatgactttgatttttctaattggttttcgccccataaaagaagttgttcaaatatagggatcagctctagtcctgccccagtcaatgaatattctactcttgatggaacttcattatactgaactcgttgaacaattccgttttcaatcaggtcctttaatgattgattgagcattgttcctgtaattccatacactttacgctttaactcattatatcgaatctcattgtaactacatagtacagctaagatttttaaattccattttcccgctaatatatttaatgcataactcgctggagctatcgctttattcagctcactttcagtcatattttatccaccccttagtcagtttttccttccttaagcagtttatattgcgtacttgttaaatcaattccatttattataatcaaatatgtaaaccgtgtcatccatgtattagagagccaaattgattataaaacccttcaagttaatactttttcaaggagatggagtgagtaaatgaaaaatgaaaagatgcgtgctgcacaatacactaattatggatcaccgaatgttctttttgaagattttatatcaagaccagttatagaatctggagaagtactcattcgtgtacatgggtcgagtgtaaactctatggatacactgtttcgatcaggtaagttaaaactattaacgggtaatcaattccctaaagggacaggagcagatttttctggagaggttgttgaagtagggtcgaacgtaaaaagttatcaattaggtgataatgtgtggggggttctccctattaatttaaggatccaaattggtagtgctgctgaatatgtagctatatcacctgagaaaatatctaaaactcctataaagattgatctcatacaagccgcggcattacctggcgtaggtgctactgcaattattgccttaaaatataaagctaaacttagaaaaggcgaaaagttactcgtacgtggtgcaagtggtggagtcggaagcattgcgattcaaattggaaaaatgttaggtgctcatgtaactgctcttgcaaacgaaaaacatcttacttttcttcaagagctaggtgcagacgaagtatttgattataaaaaaacatctccttctgatcttaaaaagtttgatgtagtcatggacacagtgggaactgaccttaaacattataggcgcttgcttgcaaagaacggtagaatggttactattggatttcctagtttttcgtccttcatatatatattaacttcaactattttcggttctcgtagagttcgcacattcagcgcaaatcccaaaaatgaaattctaaaagaattagcatcttatgtagattccaacaaggtcagaccagttgttgatagcatctatcgtttatctgatgttgccaaagcccatcattccttagaaactggaggtggacggggaaaacgtatcataaatttacttgataaaaaataaaccatcaattgacatgaaattatttaatttttctgttgcaaatggtgcatgcttggtagccatttcaaatcttccagctcttctaaagtattcagctgtttctaatgcaaagtcttcaatatcactatacattttcctactttttagaacccaaaacatcggtctaacaaatgcttatcttcttttaaatacagaccttgaagaatcttaaatttcgaaatataatcgacatccatacaattcaaatattttacatgttatgatgaatttgtaacaaaactaaacttagggggaagtattatgaataaactttacaaaggattaattgtttcagtattatcaatttcttcattagctcttccagctttaacaaatcaagcttctgcgcaagaacctgcaaaaattcacaatatagcaaagcctacaaatgaaattggaacggtcgatttccatatgttaagaaactcaaacgttggattgctgtatggctatacaagatgggaaatcatctctggcagtcaccttatcagtattagttctagtggtgtcgtatcttcttactcatcacttggcacggcgctggtttatgcctatgatataaacgataactacgtcatttttaagattacagttgaacctcgataattttgtttagaaggagtggtctattcactccttctaaaattttctttaattacatcgatttttagaaacaaaaaagaacagtcttttgactatcctttaaaaactcatacccccaattcttcagaggactccgataggcagctcaatagaaatgcactcccctataaaataatgtataattcttcttaatcacaacaatggcataatatggttaaaggagtggttatatgtcttatttctctttagttttcaagcagaattctccttcattttttgaatcaaatgatgattatttagccaaaaaagagacaaaaacaacacctatagagatttaccaaacaaataaagaggttaaatctttagctcaactaattgtattaaaaaataatgtatcagacaataaactgaacccagtttttgaaatcagcaaaaatatgaaagtaactttaaacgaactattttattctctcgattcacctaacgaagttaagtatgaactacgtgtctattatggccaagcccaatttataagtgcaaacggacacgatattataaagttcacaacagaactacatcataagaatcacccaaatgaaatcgtgactgacacaccttctattaaaattttctcttctaagttcaatgaatttagacacctgaaaggattagtgagttatctaaataccgataaaacttttacttgttattatttcggatttccaaaactagaccgatttataagattcataccttactattataacaacctgtttatcgagtattaaaaatttctctgcaatcatcaacgagtttctccataacaaatatatttaatgttttaacacagatcatataatgctcttactcgagaaatataatattatacaaatttttctctctaaaataagaacattgagaataaaacaaaaaaaccaaaggtctataacctttggtttcttagatgcggccgagaggacttgaacctccacgggttattcacccactaggccctcaacctagcgcgtctgccattccgccacgaccgcgtgtatgatgtgctcatatattcataagtgcactgtttgaaaaaacaatgcgggtgaagggacttgaacccccacgtcataaagacactagatcctaagtctagcgcgtctgccaattccgccacacccgcgtgacaatggtgagccatgaaggactcgaaccttcgaccctctgattaaaagtcagatgctctaccaactgagctaatggctcatctgctatgcagaaaaacatataaaaaaatggctgggctagctggattcgaaccaacgcatgacggagtcaaagtccgttgccttaccgcttggctatagcccaacgaatgaaaaaaacaaaacatgacccgtacgggattcgaacccgtgttaccgccgtgaaagggcggtgtcttaaccgcttgaccaacgggccataaaataatggcggagaaggagggatttgaaccctcgcgccgcttgcgcgacctacacccttagcaggggcgcctcttcagccacttgagtacttctccattatggctccgcaggtaggactcgaacctacgaccgatcggttaacagccgatagctctaccactgagctactgcggaataataagacatgtttcattatatatatgccagaaaaatgtgtcaagaatttttaagcgtttcattcctgcttcatttgcgacggcttttataatttaacatatactaatataacagtcaagcctttttccatgccatttgtttaacttggcagaaagcccccgaccttcacgtagaccaagggccttgatgcagccatcctcatgagattaagacagatgaaactttcgcatccacttataaaaagtacttcttggcactcctgctaacctcgctgcttctgacacatgacctttcgttttatgcagtgcgtctatcactgtttgcttttgaatgcgttccctgaatgtgagttcttttgaagtctcgggttgctctgctggatgcagcttctgttttttctgatcaatcgtctctaatacttgagcatattgcgattcaccaatccatccgcctttcggaaagaggacccttagatgttcaaacaggttaaaaagctctcgtatgtttcctggccaatgatacgcctgcaatttctgaaaaaatgattcaggaaacactgcattccagtgatgcttcttttggtaataacgatataaatcatgaatgtcttcttttctttctctaagcggcgggatgttgatcggatagacatgaagacgataatacaagtcttctcgtatttttccttccttcagcagttcgttcatattacggtgagtcgctgtaatgattcgaatatccaaaggaatttcgtgtgtcccgccgagcggtacgactgccctttcttctatcaccctaagaagcgctacttgcatcgcatatgggatttcgcctatttcatctagaaagagtgttcctttatgggcttgttcaaatttccctttagctccgtgacgttttgcccctgtaaaggacccttcagcatagccaaacagctcactttctaacaggctttcaggaatggctccgcaattaacagcaatgaacggccctttatgcctttcactggcggagtgaatggctctagcggcgagttccttccctgtccctgtttctccccaaatatacacatgagcatctgtttgtgccgctctcttcatctcactaagcgtctgttgaaacaccttacttgttcctgattccccgggaaattgagcaaaagaaacggtcatgctgcttttcgctgcttcttcaagagaaagggatatgcctagcaccttcccgtcttgctcagattgaatgatctgctttccccgaataacaaatgaatgatccttaagccgatcgacatccattccataccagtctgaaaatcgatctctaatcgacctgctggcagacacaatttgctttttttcattacagaccacatacggttcgtctgcttccacctgctggagacaatgagtgatcagctccatctctctccttctttgctggacttgaatttctctctctatggcataagcaaccgttgaagccattccaagcataaaagggtgcttgttatccgtcatacaggagatgtcaatcacccctatgattgtaccgtccgcatcgcgaattggagcagcagaacaactccaatgatgagaggcgatagaaaaatgctctgttccgttgatcgtcaccgcttcaccgatgacgagtgccgttccgatcgcatttgtccctacatctgtttcagtccagcgtgaaccctccataaaattaattcttcttgcttccaccatcgttctttcgcttcctgtcagacttagcacataaccatctgcatcgatgagtaaggccagcatatcagaatcttttaattgctgattgattttatttaagtaaggaagagccgcatttaggaataatgaatatttctttttttgggcactgaatcgttccttttctaacaacgactgtcctttatctaaatacggattcacatttgcctgtttacacctatgccatgattctgccactctcttattcagacgagactgatcaagcaaaccttcacgaacaaaacgtttccacgtatttaaataacaaggcgtcggattcattccatcctctcctctgggggctttttattcattatagataaatataaaagcgctttcaattatcgttggctaacccaagaagtcaattggatagaaaaggagtctttttcagcagtgcaccgctcgtccaatggtttgcagcacggcttcgtgtattgcctctgaaagtgtcggatgtgccgcaataaactgctctaatgtatcagcggtcaactctgcatgcatcatcaccgccgcttgtccaatcagttctgttgcattcggtccaatgattgaaacgcctaatatttcttgatattgcggttctacaatgacctttacgtgaccggctggttgatttaagattaatgcttttccatttgcagaaaatgcacatgtcccgatccgaatctcctcatattgttttctagctctctcttcatttaaaccaacactcgcgatttctggagaggtgtagatgcacctcggaatgacttgctcattgacctttatatgttcacctgatgcatgggatgccgcaaccgttccttcatgaaaggcagtatgagcaagctggaccccacctgtcacatcaccgcacgcatagatatgcgggagattggtttgcatatgttcattgacatagattccgtttctatcaaattcaataccaacctgatccaggttcaactctcctagctgcggagttctgccaatcgccactaagcaaagatccgactggatgtcacaccgctctccttgattattctccaccactacttttcttgaagaggaatcaagctgtttgactgcggcggacgtcaaaatgtttacacccgtttcttcgagctgttcgtgaagacattgtgcgatttcccgatcttcttcgggtaaaatgtgcagagcccgttcaatcatgacaacctttgatcccattctgctaaagatgctcgcaaactcacagccgatcaccccgcccccaatgatacaaagtgagtctgggatcgaagaaagtgacatggcatccttactgtgaatgatccattcgccatcaaaaggtgcaaacggtaaagcagcaggcgcagcccctgttgcaataatgatttgctttgcttgaatgatttcagactttccttcactttctatcaatagctcatgtgctgatagaaatgaagccttcccatttaccacggtgactttgtttttattcatcaaatagcgaacaccatcagtgagctgcttgacgacagactgttttcgtttttgaacggccttccattgaatgataggctcatgttctggaagctcaattccaaaatgtccagctgatttcacatgctcatacatatcggcgctttgcaaaagtgctttggtcggaatacagccttcattgaggcaggtacctcccagctgaccttgatcaattaacacaacctccctgccaaaacgggcggctgttatggccgccacataacctgctggtccgcctcctataatgaccagtgtcatggtacattcaccttcttcctataaaagaatggatattggttcttctaagtgtgctttaaccgttgataaaaatgcagatgcaggtgccccgtccagcacgcggtgatcgaacgtaagactgagtggcaggatggtccctttgctcaattcatcctctcgataaacaggggtgtcatacattgctccaacgccaaggatccccgcttccggcggattcaaaattggcgtgaaatgctctacaccatacgctccaagattggtgatggtaaaggtagaacctttgatttcgtcatgaagaagttttccttcacgtgcttttttgccatacaatttaatgcttttcgccagctctatcagcgttaaccgctccgcatgctgaatgaccggtacagccaatccgttatctaacgcagcagcaatcccaagatgaacattctcaaaagtttcgacaacaccgttatgatattgactgttcatcgcaggatgttctagcaacgaaaggatcgctgctttggctacaaaatcggtgatggtcaactttgtctcgtaacgtgcgatggctgtttcattcagctgttgttgtaggtttttcagttttgtcacgtccgctttcatcgtaatggttaattgtgcacttgtttgcaggctttccatcattcttgaggcaattgttttccgcatcatgttaataggctgttgcactgtctcgttttgtttcttctctttccgttcaggaagtgcacgaagcacatcctctttcgtaattcttccacctggtcctgtccccaccagcgtatcaatgtttaggtttgcgctattcgccattttacgggcaacaggggagattttctttctctctttctttggttttgactggatgtctctatctttcttttcctccacttgttcatttccttcaccgatatagcagatgaccgtgccaggcggtacaccttctccctcaggcacttttatatccaaaatggttccttcagcaggtgattcgatctccatttcaattttttcggagttgatgcttgcaatgctttcccctttgtttacggtctcaccgacctctttattccagacagataccgttccttctttcatcgacatgcctagtttaggcatcacaacttcgacagccatctccctctctcctttctctagttcaagatcttgtcatgactcttgccaatcatctctaatacggtgttcacaactttatcaggtgttggcagatatatatcttcaagaggtggtgaaaatggtacaggagtatgaggagccgtcacttttttgattggcgcgtcaagtaaatcaaatcctttatctgcaatcaaagaagagatatctgcggcaattccgcaccttggatttgcttcatcgacaatgacaagtcgattagttttttctactgaagtcagaatggcctcttcatcgagcggcgacaagcttcttggatcaattacttccgcttcaataccttgtgcagacaattgctctgccgcttcgagtgctgtatacacttgtttgcccacagcaaagatggttacatcagaaccttccctcttcacatctgccttaccaagcggcaatgtgtaatacctctccggcacatctcctgtgatattgtaaagcgtcttgtcttcaaaaaagatgacagggtcctgatcctcgatggctgccagcagcagccctttggcatcatatggtgaagaaggcacaactactttcaaaccagggatgcttgtaaatagcgcatacaaactttgtgaatgctgggcagctgctctaaaacccgccccatgtgtcgttctaatcgtgataggcacctctgcttttccaccaaacatgtatcgaaattttgcgccttgattcagcacttggtccaaacaagtaccgataaaatcattaaacatgagctccgcaattggtcttaatcctgttgaagcagctgccatagccgcacctacataaccggcttcactaatcggtgtgtcaaggacacgctcacgtccaaattcctgaacaattcctttcgttacaccaagaacaccgccccatgcttcatcatcctgtaagtgatctacatgagcgcctcctgcaacatcttctcccattaaaatgacatcttcgtctcttctcattgctagtttaatcgcttcattcaaagcactagacatgctgatttctcttgtcatttccctctcccctttctgatttattgatacgaaacatatacgtcggtcaataattcggattgatctggatattcactttcctcactaaatctaacggcttcctctatcgcttctgctacagccgcttcaatacttgatatctcttgatccgttagcagctgctgctttaataattcttttttaaaaagagtgatggcatctttttcttcttgatgttcgtttttttcttgattggttttgtagcgctgggcgtctccttcaaaatgaccataattccgatatgtcatgcattcaatcaatgtcggaccttctccattttttgctcgttctatcgcttgttctgctgcttgataaacggctgtcacatcttttccatctacttgaatacccggaataccataactggcagctcgatccacaatcgatttgcagcttgaagcataggaaaatggcgtcgcttccccgtaaccattgttttctgcgatgaaaatgactggcagtttccagatggcggcgagattgattccttcgtgaaaagtcccttgattgttagcaccatccccgaaaaagcaaacgcttacattatctgtctttttatatttagctgtaagggctgccccgcacgcaagtggaaagccgcctcccacaattccgttggcaccgagcattcctttatcaaaatctgcaatgtgcatagatccaccttttcctttacaaagacctgtggcttttccatagatttctgccatcattcctttaagatcacagcccttagcgatacaatgaccgtggccgcggtgggtacttgtaatactgtcttgttcattcagatgagcacagactcctacagcaacagcttcttcaccagcataaagatggacaaaacctggcaagatcccttttgtaaaaagcgtgtgtacttgatcttcaaattggcggatttcctgcattttttgatacatccaaacggctttttcttttgtgagtgccattttcatgataaaacctcctatcttttttgcttgcacttctatacaagcaaaaaacgtgccaacatcacggcgcttaaaagcttaggctttgagcgattcacatcgatcaaaaaagagacaaaatgagacttgcgtctctatttgtctcaatatgtctacttcgtctcacaaaaaaaagcatcccataaaggaatgcttatcactctgaaccgattgtacgctgccattttaattttcctttgcagacaccgcacacataacgagaggtatcaactcgccttttcctgataaaatattgtccgcatcctgtgcagacatattcttgccgcttctgtacacgccgtttattttgtaaggtcttgagcggtgtacaaaaacgcggggctcctacttgttttaataactctttaaaggagcggtcacgatgctgatagccttttccctcaagatgcagatgataatgacacagctcatgcttaatgattccgattaattcttctcgtccatgttcctctaggtatcggcggtttagctcgatattgtgtgttccaagtaaataccgcccgcctgtcgttttgagacggtcattaaaaacagcctgatggcggaatgccttcccaaagaactgctcagaaatatgttctgttaactgctgtaactcgctctccttcaatcaagatcgttcctttctataaaaacctcgaacgggacaatttcccctttgcatacattgaaggtacacccactgtttcgatcaaaggaggaatgggcgatgcccaactggctgaaaaatcagatgcagaaggcttttttcgaaaaaaatcattaccaaatcaagttgctgaatcaatgctggtacttctacagaaaaaaacattcagtcgcatcaaggcacaccccatcctgaggtgcgcctcgttttttgttttactctggtttcagcatggagagggcaacgcggccttttgtctggtcaacggagtccacccatacagtcacaatgtcaccaactgatacaacgtcaagcggatgcttcacaaaacggttgctgagcttagaaatatggacaagcccgtcctgcttgacaccaatatcaacgaatgcgccgaagtctacgacgtttcttaccgttccttgcagttccattccttgcttcaagtcctccattttcaacacatctgttttcaaaagaggttttggtacttcatcgcgaggatcacgctcaggtcttgtcagctgatcgatgatgtcctgaagtgtaatgatcccaatatcaagctgctctgctgcttcatccagctgaacctctgcgattttctcctttaactgctctgtgccaagatcatctggcgtcatcttgatcatgcgtaagaactgttttgtttctttatagctctcagggtgaatgcctgtccgatcaagtggatcttgtccatctgcgatgcgcaggaaaccgatacactgctcataagtcttagcaccaagtcttggaatgtcctttagctcttttctgcttgtaaatcttccaatctcttcgcggcgcttgatgatattccctgcgacagcttttgaaagacctgacacatattgcagcagcgcctgtgaggctgtattgacgttcacaccgacttggttgacgaccgtctccactacgaaggttaacgagctgtttaattgcttttggctcacgtcatgctggtattggcctactccgacagacttcggatcaattttcacaagctctgctaaaggatcttgtaatcttcgagcaatggatatagcacttcgttcttcgacttgcaggtctggaaactcttctcgcgccagtgcagacgcagagtatacacttgctcctgcttcattcacaatcaaataggagaccggctgatccagctcttgaatgaggtctgcaatgaattgttcagtctctcttgaggctgttccgtttccaatcgcaatgacttcaatgtttgatgattgaatgatctctttcactttttgtttcgcttccgattttttctgcacaggcgggtgcgggtaaatgacgccgatatgatgaacttttcctgtatcatctacgactgctaacttacagcctgtacgaaatgcaggatcgactccaagtacacgcttccctttcattggcggctgaagcagtagttttcttaagttttcagcaaaaatatgaatcgcttgttcttctgctttttctgtcagctctttgcgtatttctcgttcgatggaaggctggataagacgtttatacgcatcgtcaattgccgcttcgataaacggtcttgccgtcgtctgtttgccttttatgacttgtttgtcgagatagaaacgaatattttcagcaggcggctcgatggctgcctttaagatgccttctttctctccacgattaaccgctaatatacgatgaggcactatctttttgatgggctcttgataatcgtaatacatttcatagacatttttctcatcgctttcgatgtcttttcctgatgtgattaggctgcccttttggtacgtttcgctgcgaatccatttccgcatatcaggatcatctgccagctgttcagcaatgatgtgctgtgcgccttcaagtgcctcttctacacttgttacttccttttcttcgttgataaaagaagcggccttcttctcgatctcatcgcttggcagtgtgagtatataatccgccagcggctcgagtccttttgctttggatacatttgcttttgttttacgtttttgtttgaatggccggtataaatcttcgacctcttgcagtttatgagcctgttcaattttttgttttaattcatccgttagtttgtcttgttctgcgattaaccggatgacttcttcttttcggttcatgacattttggatatatgtatagcgctctgatatggtttgaatttgcacctcatccagtgagcctgtctgctctttccggtaacgggcaataaacgggacggtgttgccatcctctaagagcttgatgacactttcaatttgttttgttgaaagctttaattctgttgcaatttgtttcaataaaaagtcagatgtcttcatactttgcatcctctcactgtgtcttctcttttagtgtatcaaaaaaaccggtaaaacagaaaaaaggtcagctattttacgtgagctgaccaagtacataggtgagatcgtccttcttgtcttgtgtgtatgtttcaagctgtttggcaatgtctgcaactgaatggctatgctttaaacacattctcatgtttggcacattcagtccgtctgaatacataatgaatgtcgatcctttttcgtaggaataggtatatgttttatattttctaggtttccctgataagtatcctgatgtcggaagtggataaatatagtcgccagaaggggcattcaagatgaaccgaatattaccaaccgaacaataggtaaattgctgctgggaaaaattcacctttaatatggctacagtggctccgcgtttatttttcatcgcctgattgcatctgtcaatgagtgtcgtcatatcctcatgtccatattcttcgacaatttcgctgactaaagaagatgattcattggcgaactgaccgctgcctaatccgtctgccacagcacaaattagttcttcatcatctgctttaataaaaaaactgtccccgcagcatgatttcccttctttattcgattgatagatgatggcattcacatgctcatgctgttcaatctgcttcattaccctagctccatagacgcatcttctgataatgcatctcgtagcttcttaactgccttccgttgcagtctcgatacatgcatttgggatatccctaataaatcgcctgtttctttttgactcttattttgcaaataagtcagattgataatctctttttctcgatctgtcagaacatgaagcacactctcaagcatcattttttggttgacacgttcgtagccctcttcttgtgagccgacaacgtctaaaatggtgactgtacttccttcagaatccgcctctacgccttggtcgacagacagtgcttgatagcttttgcccatctccatggtttccagtacttcttcctctgtcacatctaggtattctgcaatttcttggactttaggtgacttttgcgtctctgttgttagatgatcaacggccatcttgattcttggtccaagctctttgattcgccttggtacatggacactccacgttttatcccgtaaaaagcgtttgatttccccgataatggttggaatagcaaaggcttcaaatgatttaccgacgagcggatcgtatcgcttaatggcgccaagtaaaccaatcattccaacttgtctgaggtcctcatgaaagctttttccttttgaatatttttttgccagcacatcaaccaagtttgtatagcattcgaccagcgtgagctgcgcctgctcatcttgattggattgatagctttggataaggcgatccacttcatctttagttagtttcatagttttggatggttgtgtcatggtcaactcgctccctgtttaaaaactttgtcatcgcaacggtaactccggagtttgcttgcacctcgacttcatccatcaatgtttgcattaagtataaaccaagacctccttctgccaattgatccaccgtatgagcagttgtatacggtccgaggtcttcctgcttttgtttaaagtcaaagctaccgcctttgtcagcgacaatgatttctagacgatcttcgtagacaagaaagcgaacagctacctctccatcttcaccgtcttttcctttataggcatgctgaactgcatttgtacaagcctcactgacggcaatttttaagtcttcaatctcttcgtagacatagcccattcggctcgctacgcctgaaagagtcaggcgaatgatgcctacatattctggttttgccggtattttcatctcgattagatctactgattcgttcattgtaccccaccctctgtctttgcagaaatgtcaatgatgtcctttaatccagtaatttcaaacaaccttacaagccgatctgacaagttctcaagctttagtgttccacctgctttttgagctgctttaaacaacccaacaaatacacctaatcctgtactatccatatacgtaacatccttcaaacagatctctagatgctctcccgcctcggctttaggcatgagtgtttctcttagctgaggagcagagtacacatcgatttctccactgacactaattttcgttttttgatctatttgatgctcttttacagacatattcattatgcattcacctcgaaattcttgtttccttgaattttatatacccgtctatgcactttctaaaccttccttttgaggacaagtaacgtaaaatcatcatgcagctgaaaatcttgcagcttgagtaagctgtcatagatggcatccaccatttcctgagctgaataggataggttctctgatatcagcgctttgatatcctcgcgctctaagaagccgtcctccgatttggattctgtgacaccatcagagaataagatcaccatatctcctacgtccaaatgcttctcatactgcttatagtcaaaatctggtgcaattccaagcacaagcccttttgcatctaaatcgtaaaattggttctctttattgcaatagaaaaagcccggctcatgaccagccgatgcatatttaaattcatgtgtttctttattatagctgccataaagcatggtgataaacatacttgggtctacgttttgctcgacaacacgattaagggtctttagcactttagttgggccgctccctgactctggcaaggaatccatcgcatatttaatcatcgacatacaaagcgcagccgggattccctttccaatgacatctgcgatcgcgatattaatcgtatcgtgatcagtcacaaagtggtaataatctccactcatctgttttgccggtacacttatcgccccaatatcgaacgtatctccttctggaattttcgtctccagaagggtttgctgaacattggcagcaatttcaatttctgatttaatttcttgctggatgcctctaagtgttaaatgttcctgataggcaagtccgtacccaatcatgacttcaattaagaagtctagtgaatgaaaaacatctttcggcaaatcagggtaaagctcctgaatcacttttcggtgaacactcactatttcttcaggaggtatttgatgctcaatggttttacggctaaatttttgagcttgataaagcgatgtttcagttaaatcactgatataacgactgagcagctgatggtaccgctgctccattacctccttaaaatccatggtttccctcctagcgaagccacttaacagcttgtatctccgttccttgttctggtgcagaatctaatttaaattcatccatcaatcttctgacgcccggcaagcctgctccgaggccgcctgatgtagaaaatccgtcttccatcactttacgtatatccatgatgccaggcccctcatcggctgcgatgactttgagtccacgctttccgcgctccatcacttcttctatacagatctgacctttaccagcgtataaatagatgtttcgagctaattctgaaatggccgtcgtaattcttgcttggtcaactgttccaaaaccaagttcttttgcaacattgcgccccaattgtcttgctgcgactatatcccattccgtcaatatctttacacaggattggtctttcatatctattcccccaattcccgcttcagtgtctcaagcccttgttcaagatctagtgctgtctgaatttcttccagcgatataccaagttcaatgagcgtcacagcgactgccggctgtattcctgttaatacaacttttgcccccatgagcttggacatggtgatcacatcgcctaatacctttgcgataaatgaatcaatcatatcgacggatgttaagtcaatgacaacaccgtttgctcctgtttcatgaattttattcagtaagtcttcttgaaagtgaagagctgtttgatcatcaagctcccactgtattgaaatcagaagacagttatatagttttaagattggaatcttcgggtgatttctcacttggtaatccctccaatgaaacaatttttcgatttgtcatttccaaagcagtttgaattcctttttgaagggtattctttgttgtaacctgagataaatcaattccaaggttcacaatggtttgggctatttctgggcgaataccgacaagtaaacacttcgctcctactaatctcacagcctctgacgcttgaataatatggtgggccaccattgtgtccacgacaggtacacccgtgatatcaattaagacgacctgtgagcgatgtttgacgacaccattgagcaggttctccataatttttttcgcacgatctgtgtcaattgttccaacaagcggcatgacggtgatgtgctcaaatacagggatcagcggggcagaaagttcctgcagcgcaattttttgaaggctgacggttttttcccatgagatggaatactggtttaagatctcgttatgaatgggtgtgatgaatcgatcgatttgccagatgaggtcatgactttcttcttttgtatctttgtcatcgttcattttttcatataaatgtgtacggatttccgttaggccgtttgccagtaacttaagtgatatacccatttgaacaatttttaaagcaagagtttgcactttttcttcaaactcctcattatacccctctgaaagagatgtaatgatgagttgaacatactccgaacagatggtttcatacattttgtcgttcagcatcatgtccgtttctttttctccgagtcgttttaaaatgtccgtccactctttttctaattccttttgatgctttcttgcaaaagctaacacgatatgattcgacatgttttaccccctacttacatttaaagcaattctttagtctttcttcattataacgttaataaaaattgaacacaaaaaaagttgctcccaatagagcaaccaagtctcaccatattaaaaatcaataagagccaaactaacttgtaaggcttcatcaaccttctccatcatctcatcatcaagatgtgtgattttatctgtcaatctttgtttatcgattgtacgaatttgttccaaaagaatgacagaatctcgttcaaagccgtaccgctttgcattaatttcgacgtgagtcggtaatttcgctttttgtatttgggctgttatggctgcaacgatagcagtcgggctgaagcgatttccaatgtcattttgaatcaccaataccgggcgaaccccgccctgctcggagccaacaacaggagataaatcagcaaagtaaacatcaccgcgtttaacaatcaaatgtttaacccccgctgactaatcgctcaactgtattctcagcctcaaactctgcgtattgtgcttctgaagagatattcagattaattttcgccatctccatgtagccgcgtctcatcgattcacgattttgtcgaatattacgttcacgaatatacgtttttgtcgctcggtagatcaattcatttcttgttaccttatcctgctctgctactcgttcgatctcagacattaaagtctccggcagtcgaatcttcatttcgtttgttgcgctggattcagacaaaaaacatacacctccacaaaacttacggataccgtatcgatccattccaagactaatcataccattattcaatgcacaagcaaagctgttttttcatgatttcttattagaacatgaagcggctcgccacccgtaaatcaagatgataatggagttcctccttcccattatacgcctttttccgaaaatcatacggtatttccaaaatctctaaaaaagggagaatgtttaccctacttttgtcgaataaaaaagaacgaagtcagtttgactatcgttcttttgaatgtgtttataaaaaacttggcccgccttggaggagcgggttccgtacatgcactcttttgccgtcttctatatatactcttggaacacggtggccaatcgagcacgtgacttcatagttaatggtttcaagccttttggcgatttcatcgactggtatcatgtcttctccttgcttaccaattaaaacgaccggctcccctactggaagcttgtctttcagttcaaccatgaattgatccatacaaacccttccggcgatcttccggcgctttccgccaacaagtacttccgttcctgccagcttccggatccatccatctgcatagccaactggaaccgtgccgatccacgtatcttgattggctgtatacgttgccccgtagctgacactctcacccttttgaatgtgcttcacatgggcaagttttgtatgaagagacatagcttcttcgagcttgaaaggcagttcatccttgatttcttctgacggcgacagcccgtacatactgatgccgaagcgaaccatattaaacaagacgtctttaaaccttagacctgctgcactgttggcgcaatgaacgagcagcttgtccgtatgaagcggctcaagcagtgtttgaaaggtgtcgacctgccgatcaaagtaggcctcatccttttcatctgctgtcgcaaagtgagtaaatacgccttccagctgtaaataagagtgctcgctgacaagctttttcacttcgttcacttgctcaatcgttttcacacctaatctgttcattccgctgtctattttcaaatgaaatcgtataggctgtcccatctgccctttcatcatgttggtgacgtctctcagccaatcgatggagtatgcagtcatgatgacattgtatcgaacggcgactttgacatattccggcggtacagcgccgagtaccagtattggtgctttgatgcctttatttcttaaagaaacggcctcatctaaaaaggcgacggctaatacgtctgctcctgctttgagagcagctcttgccacttctatatctccatgtccatatgcattggctttcaccacagccattagttgaacactttgaccgatatgatctttcatatgtgaaacattatgcttgattgctgataaattaatttctgcccatgtgtctctataaaaggcatttgtgtccatccgtcacacttccctattgaatgattcaatcccctcatatgatactaaaaatcaggaataaagtgaaacaaatcaaagaacatcagcccttgtatagggctgatgtttcatttctaaggctctcgcccgaggtatttatttagctgactggccttctacactctttgcaaccatcaagagctcttccttcgatagatcacttgaagaaatcaagtagtccactccgtcagatgtccatgaaagggattgatctgtcagaaccccaactgtcatgccaaggtcgactggctcgccgttcattgtcacaggcgtagatgcttcagcgactctcgctttttcctgaatgagtgtgaaggatttctttccgccatacgtcatcacataacgcttcccggcatctgtcatcatttctttctcttccatctctttcacaccctctggcatgtcaactggtgttttcaccgcaaagctgtcagatgggtctgcacttgtggcaacatccatttgagagagtgtcatgtttttcttctcatcaaatgcatctttgtcgaaggatttattgaattcaaagtgagagaattccactttcaccattggctttttgtcgctatccagcactttcacactggcaggcgccattgtttttttatgaaagataatctcttgggtaggcagcatttggttgtgctgataattggttttggtttcgaacacatactttgaatctttcgctttgaactgagcggcactgtcattcttaatatccttcacgagcgactcaaataagtagacctgactgctattatttggccaatcactgtggaaacggaagctcttgttcaatgaaggtgtcagcacaaacacaccattgccatttcttaaaatgacttgactctgatcctttttcggattttctaaatagacacggtaaagttccggcttcttgtaccaaatttctacctgatactcctgcgggtcatttcctgtctcaatggtcatttttgctttggctttgtatgatgtcatttcctctgcctttttgtttaaatctccaacgatatccttctgagatttttgaccgcatgcggagagaatcagtacaaaaaggattcccgttacaagcaaaacaaagctttttctcacccttttcaaccccttcgttaattgtgttaaaaggaagaaaccgcttgtttgactttaacagtacgcctcaagagttaactgcgtaccgcgaaccatcaaagcctgttagcaactcgcccttccttatcgcactacccaatatatgaagaggggacaaacaatatgcagactagcttgacaacctttcaattaaaacttgtgctgcagcatattctttcgtgtgagtgatggacacatgaacctgatcacccttcgtcttttcgcttttgatgaagggttttccatgttcgtctttttggatttccatgtcatgaaagcttaaatacgagccgattcccgttccgtatgctttagcgaaagcttcctttactgcaaaacgtcccgccaaaaattccagctgcctcttttcactaagtgcgtgaaagatgtcttgttcacttaacgttaaaattcgttctggcaaacggggctgtctactaagcacgcgcgcgagccggttaatctctactatatcaatgcctattcctttgatcatgaggtacctcctatgatactcgtactaatttggatgttctcttcataaacgtgttactataaacttaccattatctagtcaaaaggggtttgttatgtttattcgaacggagagctttcaacaatttattagatcgtatccaatcgtcacaacgatccttgctttgcaatttggtctatggcttatatttgcgcttcctatccctcttatacagcttggtcacgaccatctcgtcggtttcaattatggtgtagctgctggagaatggtggcgactcgtcacacctgttttccttcacggaagtctgacccatattttgttcaattcaatgtcattgttcttattcgctccagcgcttgagcatttgcttgggaaggttcgatttctgatcatctatcttggtgcagggttcattggcaatctcggaacctattgggtcgagcctttagagtatgtacatgtcggcgcttctggtgcgatcttcggtttgtttggcgtttatttataccttgttctatttaaaccgcatatgatggaccgcggcaattctcaggtaatcttaacgattcttgcagtctctgtcatcatgacgttcgtcaactcaaacatcaatatcatggctcacttatttggattgatcggcggcatgctcctagcacctcttacgctatttttccattcaaaaaaaagacactattaacctcataaaaaatgtcgatcactcctatgaacaggaagcggatcgacatttttgtgtttaagttgatttgtttttttcatacgaataccaatccattacacgtgctgcatcttcttcctcaaggtgatgcacaccaaacgaatcaagcagcgcagaggatttcacaaaggtgtgaatacttgccacccggcctttcttttggaagaaagattgcgtcatcgtatagttttgcattcgttttctcaagacaatgccagtggttttgccaatgcctcttgatgtcagttgaatcaatggatctttgatcgtatagcctgattgtttataagctaaatagccaaaaaccaaagcaataggaagcggaatgagggccaaatacccccatggcggaaaacggacagataggatcacgccgacaagtaatggcacaaagccgaaagagatcaggtagcgcttgagtgaacgctttggcacctttttcagctcagattctggctccaaatgataatcatctgtgaattgagagagcagttcgttgatttttttcttccgaatcagtggaaataagacggaagaggtttctttttctgtaatagaacctcctgcactcacaagcatcaccgtcgcaaagccaaagggttcacgaagaatattttctttgattttcactgcttgaattctcgcaagcggaatggtcatttgatgcctttcgatgagccctcttgtgatgatgatgtctttcccttttcgttttgcgttaaaattcgcatattgaagggctgttaccccaacactaagaatccacgcaatcaatacggcaataaatatgagaatcgcataaatctcaatactcgcatgacttaaaaaagaaaaccgcttgacgaatccgtccaaaggaagaatttcatctatttgtgtgtaaatggcgagacacccagaaataatgactccgatcccgcttgaagtggtcgcagccaaaagcagctctggtatacccatccggtaggaaacattgatttctttttctacaggttgctgcgctttcagaggatcatgcgggacagctccattttcatccaccatttcttcttgctgcaagcttttcttccgattgaaaatcgattgctttaattgttccgcttctgcttttgtaatcgccgtcagactcacttctggaccgtctgttcctccagctgtttcgatttgaaccctcaccaaaccaaaaatccgctggaagataccttcacttgtattcaccgtttgaattcgttctaacgaaatatattttttcttttttgtgatgacgcccgattccacacgaaattcatcatcttccattcggtaggtgaagcgcctccatgctaaaacagttaaaacagctttccataaaagaagcacaccaagaatgataaatgcataaaaacgaatgctcgaattcgagttcacaaaaataagcacgaaaaaagggataatgaagtttttgatcatggatacggcatctgagataaaatcaatgaacatcgagattggatgtacacgttttggttcagacatcatcttccgtcacccttgctaaacgagatatgtaatcacgaagctcatctgcttcttctaattctagcgccggtatatcatgaactgtggcagcagtcgatatttgaacagatgccaaacggtagcgccttaaaagcggcccttgtgatgtatcgacatgctggacacgcaccatcggtacaatcacacgtgtgacacgaatgagcccatgctgaatttcaatttcattttcgaatacttcgtagcgccagatgcgatgacggattttcggtataagccaaatgccaaaaatgacctgtaagacccataaaccggcgaggatggccccaatccaatatggccattgaagataataactagcaacaaataccccaatgatgatgagtaagaaaatcaatgagataattccattttgaagacgccatacctttaaaccatttaaactaatttgacgttgcggctgttttctcacattcttcccccattctcttacttttctatcaatatattacgaaagaaagcctaaaaagtttcagtaaacctgttaaaaaaagcgaaccctgcaaaggattcgcttttgaattagttgttataagatttcttttgacggcgatcgctagaagaacgattgcggtcatttgaagaacgctttttatcaccgtaagatgaacggcttttcccgcgatagccgccgcctccgccgccactctctctacgtttagaagagctgcggttgttacgattgcgttttgaaaccattggtgcttcatctgtcaaacgaacaggcgttgcatccggttcttttgtcatcattttgatggcagccgcaaccactgtgacagaatcatgatcttctagcaattcagcagcagctgtcatgtagaagtttaagttgttttcactgatgatggtgcgcagacgatcaatagttacttgctgttgaccttcaattgcttcatctagagttggttctttcatacgttccattttacgtttagtcgtttgctcaatcgcacgaagcatatctttttcacgcggtgtgatgaatgtcaccgccatacctgtacgtccagcacgtccagtacgtccaatacggtgtacgtagctttctggatcttgtggtacgtcaaagttatacacgtgtgttacgcctgagatatcaagtccacgtgctgcaacatctgttgctacaagcacatcgattgaaccttctttgaatttacgaagcgcaaccatacgtttcgcttgagtcaagtcaccatgaattccttcagctgtataacctctaaggttaagtgcttcagtcaattcgtcaacgcggcgttttgtacggccgaagacaattgaaagctcaggtgattgaatgtcaagaagacgagtcaatgtgtcaaatttcttacgctcgtggatatccaagtagaactgttggatgttagagacagtcatttcttttgcttttacttttacgtgttctgggtttgtcatgaaacgttctgcaatgcgcttaattggtgcaggcattgtcgcagagaataaaagtgtttggtgttcacttggtacatttgaaaggatcgattcaatgtcttcgatgaaacccatgtttagcatttcgtctgcttcatcaagcacaacagtttcaacattttgaagacgcattgtacgacggttaatgtgatcgagtaaacgtcctggagtccctacgatgatatgaggatttttcttgagcgaacggatttgacgaccgatatcttgtccaccgtaaatcggaagtacgcgcgcacgcttgtcttggccaattttgtatagctcttcagatacttgaatcgctaattctcttgttggcgcaatgataatcgcttggatatttggagacgctgggtcgattttttctacaagaggaataccaaacgctgcagtttttcctgttcctgtttgtgcttgtccaatgacatctttattctgaagaccgagaggaattgtttccgcttgaatcggtgttgcttcttcaaatcccatgcggttaatagctttcatgagactttcgcttaattgaaaatcttgaaacgttatagtcaaattattcaaactccttctaattgctgtttcagtaatctcgtgaatgatcattaaaaactgcccttttctgaaaggacaggtccattatatacaaagcccgaattaccctaccttatatcttaccattacactatttgtttttcaacaagacagaaatggatatatctactgttccacaatgacagattcaccatcactttgatcgccatccatccatttccacttttcgaacagttgaatttttccgttatccaactgattaggtgtagaattgcaagacccgcttctcatgctgccgtctttgctgacatggtggtacctaaaatgaagtgttccatcctcatttacagttcctacaagtacaccagatacaatactgccgccttgatacgtgcccgttaatatattcccgtcctgacgatattgaaatatggtgcctaccgatacttctccgttactcgaattagactgcgggacaaaggtttttccgtcatattgaaacaaccgaatcaaccaccttttctttcctattgtaccataggcttgtcactcattcgacaaaaatgatgtaatttttaacaagtgggattcaatttatattagtttagccacattttcgcttttctatagattaaattgtttttttaagaaattcctctactttttcaaacaattgctgtgcacatggctcgtgacaaacatgatgtttacaatcaggtaaataaaacatttctttctgacgggacgggattttatgatcaataaattgtgcactagaagctggcacaatcccatcgctttccccttgaacaattaacacagggaggtgaagtttctcaagagagctcttcgtttgcttcaccagcttcataaattcaacagcggctgacagcggtgtgctcgttagcttatgacggtatctatcatacaaagggttcgtatcaattagcccagacaatgattctttcaccatctgccttgtgtcttgaatcatttgttttggattcacatatttcgccgcagcacttaaaaggacgagacgagcaactggatacttcgctgcaagataagcagcaatcattcctcccatagaaaacccgatcaaaaaaatggtatcacatgttcggtaaagagaaagaagttctaattcagctgtcgcaatccattcttgatagagaataccttttagctgaagttcatctccatgccccggaagcgtgacagactgaacgttccaatctgtcttctgctttaaatattgcgctagcggttccacttcatagggggcgccagtaaatccatgtatacagagacagccaatcattctgtcaccttctttgccgctctctttttatagtgcagtaatgatttcttctaatctcatgccgcgtgaggctttgacgagaacaacatcgtcaggacctgctacgtcagcaagttttttcttcagttcctctttgtccataaatgagaacacacgcgcatcaccgaatgatttctttgctccttcagcgatgaatgcacctaggcggccatatgtcatcacatgatcaataaattcaggcttgatgtagcggcctagttcataatgatacgtttcttcttcgctacccatctctagcatgtctccaaggacaagaatgcgatttgcgaagccgtccatatctcctacaagatcaatggcagctttcatggaagtagggcttgcattatatgcatcattgataacagtgattcctttttctgttttaaacagttcaagacgcattcctgttaattttgtttgcatgagtccttgggcaatttgtctttcattcagtccgaaatgctgacctatggcaatggcagcaagggcattcttcacattatgtttccctaatacaggaatgagaaacccctgggcatacccttcgacctgaaattcagttccttctgcaagctggttgatatgcgttaccttgatatcacagtcctctgcttctccaaaggttttcacttgctgcgaaagtacagtcgctctctcgcggatcaagggttcatcacctaaataataaaaggtgccatcctttttaagcccttttgtgatctcatattttgcatcagcaatggcttctcttgatcctaaatcttgcatatgagattctccgatattggtgatgactgctgcatcaggctcagctaggtttgacaagaactcgatctctccttttgcgctcatgcccatctctaatacagctatctctgtaccttctggcatcgcaagaatggtgagcggaagaccgatatgattattaaagttaccgtctgttttatgaacttgatacgttgtttgtaagacggaatgaatcatatctttcgttgtcgttttcccgttacttcctgtaataccgacaacacgagggttttcttcttttaaatacgattttgccaattgctgaagtgctgccagagtatcatcgacaagaatgacaggtacgccttccggtggattggtttctttttgattccaaaaaacagctgcggctccaagctccactgctttagaagcaaatgtgtgaccgttaaaatgttctccaattagggggataaacaatgcaccttttgatacttttcgtgtatctgttgtcactccgtgaatttgctcttcgccaaaagcttgattagatagtgtcccaccagccatttgggcgatttgtttcactgtacgtttgatcatgatttttcgcctctctttctcatttcacgtttgaaggaaaagagacactacctaaggatagtgtctgcttgttgctcacattaaaaagtcgttttaatggtttgtttttcttgatggcgttcaattgcaagtgacactagcttttcaatgagctctggatactctacaccagtgtgcttccaaagcagcgggaacatactgaatggtgtgaatccaggcattgtattcacttcattgatcaacacttcgcctttttctgtgaggaagaagtctgcacgtacaagaccagaaccatctagggatttaaatgccttaatcgccatatcatgaatcgtcttgtattcataatctgacacacttgcaggaatgatcaaatctgtatcgccatcttcatattttgctttgtagtcataaaaatctgttttaggtgcaatttcaccaacgacagagcatttcggctcgtcatttcctaatacaccaatctcgatttctcttcctacgacgccttcttctacgaccacacgacgatcatattggaaagctaagtcgaatgcggtttgcagctcttctttgctacggcatttgcttattccaacacttgatcccatgttggcaggttttacaaagcatggatagccaagtacttgttctacctgttctaagctgtctggtgtggctttctcatagtcttttttattgaaggaaaggtgcttcgcttgtgcaagtcctgcttgagcaaaaacatctttcatcatgactttatccatacccgcggcagaagcaagaacgccgttgccgacatatgggatatttagcagttcaagtaatccttgcatcgttccatcttcaccatttggcccgtgcaataatgggaagacaacatcaatcttctcatcagcggatgcaggctgtggaaacatgctctcatttaaagaagttggtaaaaacgccttagcattctgttcaaattgaagcattctgacgtttgatactggttcagtgagtttttctcctcttagccattcgccctcttctgtaatataaattggatgtatatcgaacttctcagtgttaagtgcttttgtaactgcaagggctgtttgcagtgatacattatgttcggctgactttccgccgtaaatcaatcctaaacttattttcaatggatactccccccactaaaattcatctttactatcttatcactttcaagcaaaaatgctctaattaattttttgttgttacggaattgaaatgatttgtaaagttgtaagcgcctcccgagcatttgtatgtcattcgcctttattttatattaaaatgacattgaaaaggagttgtgacaaattgaaaaaaatcacaagtactgaacaattcaatgaaatcattcaatctgacaaagaagtcatcgttaaattctttgcaacatggtgtcctgactgtacaagaatggacatgttcattccagacatcttagaggcatatgctcaccatgaatggtttgaaataaacaaagatgatttccctgaattagcagaaacgtatcaggtcatgggtattccaagcctgttaattttcaaaaatggcgaaaaaacaggtcatttacacagcgcaaacgcaaaatcacctgaagaagtgacagagtttcttcaagggcacgtttcttaaatcgtgaaacgaaggacatcagcaaccacttgctggtgtctttttttctccatcccttacatcaaatctcctcataagacgatttgatcaatcaaaacgtttcaacgagcgaaagaatgttttatatagatgcttctcttaagacaagaaatgacaggaattatttcctgggaaagaatgagcgtcgactaggcatcgaatttgtcgattacgtgaattttctgaatataatctttacttccgacattgcgctttgtataatagaggtgctaattgaaaatgattatcaatttcatctatgtgggatcctatagacgtctattcttataaaggagcgatgagtcacatgtctaagaagaaaatcaaaacgtatcagcaattgattgaagagaacaagaaagccatcatgcgcgaccctaaaatgatggaaagtatatacgaaaccatcgacaaaaagcatcagaagcagcttgcggctgctggacgcgaatcataaacataagggggagcagtcaaagctggctgctcctctcttttgtcttttccaacaaaaaaagccgataaaatctatgctttgattttatcggcttttgttttaatgtgatttcgctacacggtcctgcttcattcctaaataaatgagcatatatgtgagataacccattgtcattgttaaaccaccgaagaagaactgagaaaagacaggctcctcaaatgttgtgacagcagcaagaatgatccagctcgcatataaataaaccatgaaccatttcatgttttttttcagtgtatacagaaagaaaagacccgctaacgaaaagattcccagcgctagtctgaaataaataagatgatcaaactggaaggcaaaagacacgaacgaaaacgatagcagcaacaaaataggtaaagccgtaatgaaatttttcacgatagtgccacctccaagactccctcttattataagacaaaatcagccggttatcgtgaaatgcagactcgttttcacaaagatgtcacgaatttttcttgttatttgacacaatttttacacatttacatcgcgcttccaaaaaagaacccaagccgtgccaacaaagaaaacaaaatgcgcccctaccataaatagagaaaacaaagggctcatgccatggaagggcggcggtccttgaaagctgtactgagtaaagtccgtattagcaaaaagtaggattttcccccactgattttctaaaagagacataataggcacaagtgatttagccgcatataaaacaaaaaacgaggtcacaagcgcaacgaggctgttcctaaacaagctggaacacataaaagcgaagcttgccatcatcaacacttccacccactgagttccgatcacagcaaacgtatgctgaaataatcgtcccgtactttcgtcaaatgcagtaccaaagaaaataagaccaaataggaaagcaagtacataataaaaaacaaacaaatagatgaccgtcagcacaagtgtgatgtattttgacaggaaaatttgcagcctagttttgggccgtatcaataaaaacttgatcgttcttttttgaaattctgttgagatcaaggtcgcgccaatgacaactgcaagcacctgtaaaataaatacgacgtttgtggaataagcaaaatagttggcgacagtgtcttgtccaccaaagctggaaatgactcgtttcaatgctagagccatcgccaattgaaacacaacgatcaatccaagtgcaatgaacgtgatctttttccttatcattttcttatgctcattcttgatgagttgaagcatctgccgtcccgccttccgtccatttcataaatgcctcttcaattgatggcttttgaggcgtcatttcaagtacatcaaatccagccagaacaagctgtttgttcagctcaggcacttgctctttgttcaattgaagtaaaacatgcgatccatttcgttcatatgtatagtcatgtgtctcgagccacgtcactgccttttccactggctgaatattcatgagcatctgttcttttccctctatgtcccgaagcatggcactggctttgatctgtcctttttgaatgatgatcatgcggtcacatagctcttctacctcatgcaataaatgtgtagcaaataagacggacgttccttcttctcgtactaacgattgcaagtgctccctgaattccttcataccggcaggatcaagtccatttgtcggttcgtctaaaatgagcaggttcggctgatgtaatatggcttgtgcaatcccaagcctttgtttcatccccagtgaataggtcttcaccttctgatgaatggcgtgctccagacgaactcttttgaccacttcctgcattcgttcctccgtcactccatcgtgcatcgccgcatatagttcaaggttttcaaagcctgttaaataagaataaaattcgggattttctatgattgcaccaacagaggacattgcgcgtaagaaatcctcatcctgtgaatatgcattgatcatgatgcgcccgttgttttttttcatcaagccaacgatcaaacgaatcaaagttgtttttccagagccatttggccctagtaagccgacgatttcccccttccctatttcgatcgatatatcttgtaaaatcattttccggccaattcgtttatcgactttctctacttttagaacagcagactccaacgtggttcctccttctgatgtaaaacctttggcggcaaataaggccactcattctgttaaaagtatatcacgcaagacaaggaactccatgaaaaaaagggctgatcgagtcagcccttcttttacattacatggatagattcggtgatgcttcgtctttctcgtgttttttctccgtttctgtcacaatcaccgcacatgcggcgtcacctgtaatattgacaacggttcttgccatatctaataagcggtcaataccaaggataagcgcaatgccttcaaccggaagcccaaccgaatttaataccattgcgagcataatcaatcctactcctggtacaccggctgtcccaatactggctaatacggcggttaatacaactgtgagcatttgcatgagcgttaactccacaccaaacacttgtgcaataaagatggttgcaaccccttgcataatggctgtcccatccatattgatcgtagcgcctaaaggctgcacgaaactagaaatcggctcaggtactttcaatttcttttgagcggtttccatagatacggggagaaccgcactactgctagacgtactaaaggctacgaccatcgcaggcgaaaagtctttaaagaatgtaaatggatttcgttttgcaaataaagccaaagttgagccatatgtgagaaagaaatgcaccaatagtgctactaatacgactgtaaaatacagccccatggctttaatagcctcaagaccttggctcccgatagccgtcacaattaatccaaatgtcccgtatggagcaaatttcatgaccactcctacaaggtacatcatgagttcattgccttgttctaatattttgagtattccttctgtttttttgcctagcactgcaattcctagtcctaagaatacacagaaaacaatgatttgcagcatatttccttcaactaaagattgaactggatttgatggaatgatgtttaataaagtgtctgtcgtagatggtgcttcttgaggttcgtattctgcccctttagtatcgaatgaaccaaaggaacccggtttgattaataatgctaatgacatcgcaatgataatagcgaaggttgtggtcagtagaaaatataagatgctttttgctccaatacgccccagtttttttggatctccgaggcctgccacaccaagtgtaatggaaaagaagacgattggcacaaccagcattttgattagatttaagaagatttgacctagaggtgtgaatagataaggatctaacactttgaatacatttggagcgaaaatgttaagcaaaagtcccgtgattgcacctacaataagggcaataataatttttgtcgccagcttcaataaaatctccccttcctcgtcaaaaagacccacgagagagttttctcgtgggtctgcgtgtccttacatataccaccgtttactctcttcacgccgatgaggttagctgacgggttaggacgaagagatgtccttttttctcaacagagaaaaattcaccccaaaaacatgggtcccccattcctttagaaggattaagcgtgtggttattatgatattttcatactatttataccttatttttagaaaattgtaaacaggttcaaatgaactttttaactactttcctccttgttggtgacctccaaaatatctaggataaacacaaagattggtataccaataataagaccccatatcccgatgtagtgttcagagaagatcagcacaacaaatgtgaagaaaatagggagttctgtttttgctgacataagctttgggtttaagaaataggcttcaatcgcatggatgatgacgatcacaagcacgatatacaggacatacatgccgcccccaagcgtatacgcaatgatgctgagtggaataagtgagatgaccacacctgccactgggattaagcctagcaaaaagaccatgactgctaatccaaataattgcgggaatcccataatgcctagggcaatggttgttaagacacaattaacagttgcaataataaactgtgcttcgagaacctttccaaacgttctggagaatttacgtccaaagaaggcgatttcatggtagaacacagagattttactcgttttgaacttgttcatgaattgaatgaggcgttctttttcgaacaggaagaacatgcttaatattaaggacataatgacctggatactgaacgtactgaaatctgttaagtatgtatagaggaaattaaaccctttctcaaagtaagctgatattttaaaatctccgaatacgttggtgatgacatcaaagaagggtaaattttgtggatgatctgcaattttctttcctaaatgaaatagttgctccacctgtttggcgatgattggcacaaacacaaatccgccaaacgtcaatccaccagccaaaagaatatacaaaatggtaataaccgatttctgacctattttcaggaagtgacttaaaaagcctctaatgacctcttctaaccgattcatcaaaaaggtgaatatgaaggtcaagagaattaaattcatcattcctcttaatagatataaggctgtggctaatactacaaatacagaaaaccgcttaacaccgggtttttcgaacaattttaaaaatgctgccattacgttacacacctgccaggactaaagtctatttttcattggatctgatatacattatatcggatctttctgtaaattatataacaaaaggtcaatgaggtcttacgattcgacctaaatttatcaagctttaatgttttttcttttcaacacaagaaaaaaccgaacctcatgtagaacataaggtttcggtttttggttgtttttatactatacagcttgctttatattacgcatttcttgaagggctgttttgctcttcgcttcgtcaaattcaccttcacttttcgccacaacaattgtcgcgattccatttccaatgaggtttgtgatggctcttccttcgctcatgaatcgatcgactccaagcagcagtgcaagcccctctagcgggatgacctgtagtgcagcgagtgtagaagccagcacgataaatccgcttcctgtcaccccagccgctccttttgatgtgagcatcagaacaaggataatggtgatctgctgaccgatagataggtctacaccaaacacttgcgctaagaagaccacagccatcgataaatagatcgaggttccgtctaagttaaaggaataccctgttggaatgacgagtcccacaacagacttagaacacccgtagcgttccattttatccatcattcttggcagcacggattctgatgagcttgtgccaagaacaattaaaatttcatccttgataaatcgcaggtaaccaagcagactgaagccatacattttacaaatgatgttcagcacaacgaagatgaacaggaacatcgtcaaataaacggagagcatcagacttgcgagcggtttaattgatgccaaaccaaaatgtccgatcgtataagccattgccccaaatgccccgagcggcgctgcacgcatgatatatccaatgattttaaagaaaaccagtgacagcttatcaagccactcaatgattcctttccccttctcgccaagtgcagcaagcgcaacaccgaataaaatagagaagaataagacctgtaaaatatcacccttagcaaaggcatctaccatattagatggtacgatgtgtgtgacaaattccatccagtcgataccctgtcccccattttgggtatactgcgaaacgtcccctttttcaagcttactatagtccagacctgcacctggcttcatgatattgacaacaaaaagtccgatgaccaaggcaagcgtcgtgacgacttcaaaataaataaatgcttttcccccaacttttccaacctttttcatatcccccattttggcaataccaagaacaatggttaagaaaataattggtgcaatgaccattttaacggcattgataaaggtgtcaccaagcggcttcatttcttttccgacgtttggccaaaccatcccgacaatgatcccgataatgacagctgcaaccacctgaaatgtcaggttcttcaaaagcctcttcataaaaaatcaactccctcaccctttgatgtaaacgcttaactgttatctgtagctaaatgatagcgatttcaccaaagactgtgaagcttatgaacatatcgtacattttggtctttttggtctcttagtcagaatgtacgatatatttattaacaggccggccaaccccgccatattgcatatctaatttcagctcgccttctttcactaagaagtctaaataccggcgtgccgtgacacgtgcaatgccgagtgcattggcaacttcctctgcagactgcggaccttcctgcaagctcatataggctttaatttcattcatcgtatgcacattcagccccttagggagccaagtatcttcctgcttaacagcaggctttcgtatgatatcatccagcatctcctgagaaaattctgctgctgtacgaattttagatttaaacgctttatagctttcaagtgattctttcatacgctcgaacttaaatggcttgatgatataatctcgcgcaccattttgaagcatggtgccaatcgtctctttgtcctttgctgcagaaataacgatcacgtccacctgtatcttttgctttctaatgtcttgaagcgtcttcacgccatctttttttggcatatatacatcgaggacaacgaggtctggacgaatttctttgatgagctggatgccctgctccccattacctgcgattgccgccacttgaaagccaggaacactcttaatgaactccttattcacttcttgcaccatcggatcatcttcaattaatagcaccttaatctgagtcatctgtctctctcctctatgatcattgggaattcgattgagaaggtggtaccaatgccgatgcttgatgtgacttctacatttcccatccctttgtcgataatcgtttttacaatatacaggccgtagcctgttccgccttctttgccgtgtgtgaaacctttatcgaaaatataaggaatcatttcctcttcaatcccagagccattgtcttcaattaaaatcgcgaggacatcctcggtttgatcaatactaatagacatgcgttttgtgtctctttctacagtatcataagaggcaaaggcattctcgatcaggttgccaagcagctttgtcatatcatgctgatccagccgctcagggaaatcacacagacagctatgttcgtctacttcgacttttatgcctagctccttgccccttctgattttactcatcaataatcccgcaacggcatcatgctgaataacgcggtgaagaaagtccagcacatgttcttgctcttccgtcgtttgaaaggctagatcaagtgcctgatcgggtttaccaagctgaatcagcccagcaatcgtatgaagcttgttcatatgctcatgattttgtacccgcagaccgtcaacaaagttcttaactccggttagctcctctgccaattttgccgcttctgtccggtcctgaaaaatggcgaccgctccgataattttctttttcatgacaatcggaatcctgctgctcataatccgctttccgctcatatgaatttcttcattatagacgggctcagcgcgatcaataatctctggaagccttgtgtcagacagcacaccccaaatattcctgcctacgacatcccctgtcacgccaaatatttgcttcgccttttcattaaaaatggtgatcatgtgctgattatcaatggcgataaccccttcattaatagagtgaaaggttgcggtgcgctcctctagcattctgacaatctcatgcggctccagcttaaacatttgctgtttaatatgacgagcaagcaaaaatgaacctacaagcccaaagctgagcgtcagcaaaagaatcatgaggatatcccgcttcatttctcctaatatatctaccatacttggcagtgttctccctacaaggacgacccctgtttgattaaattggtcatccttcactggataaaaggctctgatggctgtcccaagctctccctctgcttctgagaaataaatgtgctcggcaaaagcaggctcttcatctgtcccctccgagcgctggccaatccttgttttcactggatgcgttaatctcacatgatccatatccatgacgacaatgtagtcagcgtcttgaataatccgaatctcttcgatggcatgctgtaatcgatcacgttcttttgtttgatcagctaatgcctgctttacctcattcatctcagccactgttctcgctgtgttcatgagcctttttcgaagctctcgttcctctgtttgctggattcccccaacaaggacaattcctccgattaaaagggcgaaaatgacaacgaaatatgtgaggatggtgagcttccatctaatagataattgttgtaatttcaatcgatttctcatcatttttttcacctgtatctttacgaattcttcctcggtcaagtatgcttgacataagggggatcggacgcatgaagaatttactcgcctatacactattgctcttgatcggttttgtaaccgctttatactttggcttttatcatatgatgccaaaagcagcgacaacctttgacgatgaacagacagggctgaaggagcagcttgttttcaaatttagccatgtcgtggcagataatacaccaaaagggcttgccgcaaagaaatttgctgagcttgtgcacgaaaaatccgatggcaagatcaccattcaaattttctccaacggaagcctttattctgatatagaagaaattaatgcactcaaagagaatcaagttcaatttatcgcaccatctacctcgaagctcggcatgctatcccctgagtggctggcacttgaccttccctttgctttttctaattatgatgcggttcaagaaggcttgcacggtgcaattggacaaagattgtttggcaccctgcaaaaagacgggctaaagggaatggcgtactggacaaatggctttaagcaaatcacctctaataaagggccaatcaaacagcctaatgatttaaaaaaccaatctctccgcattatgcaaagcgacatgattgaaaaacaattcaaacttcttggcgcaaagccctatcaggaatcgtttaattcgacgttccagctactagaaacaaaaaaagtagatggtgaagaaaataccatttcaaatatttattcaaaaaaattctatcatatacaagactatatgacgatcagtaatcacgggtatttgggctatgtggtcttaacagatcaatccttctttgatcgccagacacctgagacgaaacgaattttacttgaagcgatggaagaaacaacagcttggaatgaaaaacatgcagaacagatgaacaaggatcaactggaggacattaaacgggaatcaccgattgccattcatgaattgacaccagcagaaagacaaaaatgggtgaaagccctcgatcctttgtatgaggaagccgaaaaaaccattggttctaccctaatcaaacagattcgtgagctgcgtgcgcgttatgaacattctccgatccatgcttttcaagaagaggataagaccaaataaaaaatccctttgagtaaggggatttcagattgttgacaaagggctaaaatgatcttgattttagccctttgtcttcttttcagcgtgatagaaaacctttgcagccctaggaaggacggctacttttgcggagcgaatttgacattcgtaagcaccagcgtgcaggactgataacgaatgcgagggtttgtctacacgccgcgttatgcaccagattcactctgttcttgctgcgtgagctcttctaatcttgaagcaattcttcgctttcggtattgcatcatgcctgtttcggcaatactttttagttgtgagcggttggaaactgcgccaaataaaatccctgctactggaacaaactgaaacagcttcttccagccaaatgaatctcggtaattatagactacctcacgccacccttggatttgcgagaacatgttttcatgtttcccttcggaagcatgatagcttctgagctcttttaatatcgattttttcccaaccacatcagcagaggtcagctgtaagcattttatgatgaagacccgttcttccttgtttttaggatcatagccatatgtgacggcaatatcctgtaatgttttaagggagagaccaagtaccgcaggaatatctgcagccagtgtaaacataccaccgacacccgttgtcgccccttgtaccgtggcgagatttgtcctatttttccccatatgttcactaatggcatccatgatttcaattggtgctttttcaatatcttctatacgctgaatggaatcatcggcacatttcttttgaaattgatggatgatgcctttttctgatgtcaaataggcacctcctgattgaatgtaatgccccatttcatctagcagcacaccaatttttttctggataaaggcaggcgtcagcttgtccagcatttgaaatggcaggcggctgagtttctcccaaaaccataccttttgctgatctttctcccactgttcaatctgctttaattgtgcttttagccactctctttcctccatgcctttttcctccttagatgctgctgaagtatttgtttgttattatacacaatccttttccatcatacgtatagaacattgaatcggtttcgaaaggtttgaaactttttcaaaacggttattgcttaatacacaaacaaaaagaggagtgatcaacatgttaggatttctgatttcattagttgtggcgattgtcatcggccttattggcagtgcactcgctggaggtagtgtaccaggaggatggatcggttcaatgattgcaggacttgcaggtgcttggattggtcatggattacttggaacgtggggtcctagtttggcaggctttgcgatcattccagcaatcataggtgcagcgatctttgtcatcatcttaagcctgatcttccgtagtgtgggatcaagggtatcttaaaaaaacaaataacagaggaaacagtagggacaccgtctaaaaggcggtgttttttatgtgttggattgacaaggtatctatttttttcacttacatatgataaacaaacctattagttcagatagttgacttttcataaagatgggcatatgatgattaaaaattgcatcaaggaaactttttgtgcccaagcaaaactttgtagaatctaggtgatgacatatgacaaacaaatacatcgaggcacaggcatacatgtcagaggcagctgagcgtgcacttgaaggaaaagtcaaagggtttagaagactccttccttttctcggtcctgcttttatcgcagccattgcgtatattgatccaggaaatttcgccaccaacattgcggctggctccaaatatggatatcttcttttatgggtcattctcatatcaaatctcatggctttgctcattcagtccttatccgcaaagcttggaatcgcgacaggtaaaaacttacctgaaatcgcacgtgaagaatttccaaagcccgtttcgatcggtttatggattcaaggagaactcgtcattattgccacggatttagctgagtttattggggcggcacttggtttatacttactctttcgaatcccgctgcttgaagcatccattatcgcggcgatcggctcatttgcgatattggagctgcaaagacgaggatatcgagcattagaagcaggtattacaggcatgctatttgttgtcgtgatcgctttcgctgtacaaacctttgtcgccaaaccagatatcgcaagtgtcgctagcggattgttcattccaaaatttgatggcgcagacagcgtgctgcttgcaactggcatattaggtgccactgtgatgcctcacgcaatctacttacattcagctttaacccaaagaagagttgtcggcagaacggaaaaggagaaaaagcagattttccgctttgagtttttagatatcctcattgcaatgatcgtcgctggggccatcaatgccagcatgttgattgtggctgccgctttattttataaaaatggtctctttgttgaagatttggatgttgcgtttcagcattttggtacactcgcagggcctgtatcagccatcttatttggtgtaggtctgcttgtagccggactctccagctcttctgtcggtacattgtcaggcgatatcattatgcagggctttattcaataccggattccgctgtatgttcgccggctgattaccatcattcctccgattgcgattattgcatctggagtgaatccgacctccgcgcttgtgatgagtcaggtcgttttatcgtttgggattgcctttgctctaattccactcattttatttacaagtaaaaaacgaattatgggagaattaacgaatgcccgctgggtgacaggaatatcttgggtgatagcagctcttgttgtagcacttaatctcttcttaattgtagatacgtttatgtaaaagacagtgttgagctgtctttttctttccatttggttatggtagaattcccctgagaggatgtgggttcatgtttgtttatcaggatcaagagatatctatgcggctgcttgagccaagagacgcaagaagtctgtatttgctcatccagcggtcgagagagcatttacgtgaatggatgctttgggtggattccacacagacagaagaagacagtatggcgtttatccaaggtgcgatgcagcaagcgatgcagaacaacggttttcaagcgggtatttggtcacatggagaacttgtcggcatcattggcacccatcaaattcattggatcaatagaaccgtttcaatcggctattggctcggagaaggctatcaaggaaaaggcatcatgacaaaagcatgccaagcagtcattcgctatttatttgaagagtgcgggctgcaccgtattgagattagggctgctgtcgataaccagaaaagcagacgcatcccagagcgattatccttttcgcttgagggaattttacggcaatgtgaatggctgggcaatcgctttaccgatcattgtgtgtacgcccttttacagcctgaatatatgaaacaaaaaacgcattcgatgaatcaacccacttaattgtgtcgattgcatgaattattttacaaagtgaagctttgtagtatccgttgtgatcggcatctgataaaatagaaggaaaaatcgaggtatgatgtatgtctcttattattttattttacttatggattgtccctttagtatttggtattttcttctcattcctaacaaagaaagccacctacaaacgccgctttgtcccatcctatagcatgataggactcagcatcgtttttctcattctggcactcgtcttttcagccagccattttctatttatttgcggtatgttcctatttgccaccacactagttggcacaggcatccccttattcttagcctttggaaaaacaccatcctaaacaaaaaccaccttttcgcaatggaaaggtggtttcttttttattgaagcggcatccggtatgtcattgtggcatttggatgttcttcaatcgtcttcatcatgtcttgaaggatctcggctgcgcgatcatttgagtcatacttgccgagcatctttgcccaagaagtacttcctaagatcatcccttcaatttttttgccgcttactgagacttcttgtatatgaattagagtttgctggttttgtgtgaagatccatagcatggttttttctccttttttgtggtggttggattagattaatatatgatttccaattatgtgtggagtgatttggtttgctttttattagaaatttcacccgtattttcattttcaagtttctcggacatgatacttattttaaggtcactcaatgttttttcctccattgctttcaaaaaaacaaattcactttattcttttatcatatcaatctttacatgctttgaaagagaacgatggacaattagtccatcgttctctctctagttatttaaaaattaatttcttttctgtctctaaaaactcttctacaagttctttaattgtattttttgaatcatgagggtaataaaatgcgtctgaaacttttctaaagaagtcatacatattttccggtgtattaaagattgaaaaaatattttcaatttcttcaaagatttcttcatcacttgagttaatatacgtctctttcatagtgctatatagccacttatgatattctcttttcatgtcttccgaagaactgtcagaggttatgctttcaagtatattatctactttaacttcttcttgttcccaagctaattcaaggattaattcattattagcattagggttactttctaagtatttaacagcatagtttgttacttctaaagcagaaattaaattaaactgtctaccaacaagcagcgtagaccagttacaatcaaaaccatttttcgtgattatttctattttatacaatttctatttcccccattgatttatttttcctgtcactttgcccccaggtataaaagttctatgggtcactgtattcgttgttggatctaccacccattcaaacacgccattccttatttctttcgactgtaacatttcaggggcattgttctttacttttacatatttcgtttcgtacttaaccactgagccctctatttgatacaacgaatccatatggccttttctatttggtaaatcaaatctcttagaatgaactgcgtagttgtcaattatatcattaaagctatgataaaaatcatctttcaatgcactacctactcgtggattttctaaaactggatgcttaagttccctcgtattcttaatccccatcttcccatgaaaccctttcgccccaaacggcaaaagcattccaagcgctgcgttcatactcgcttcctgctgttcttttgagaccttattaccaaacatatcacggcccgtaatcgcttcgctgaagccgttggtggcggtgaggccatataagcctttttgagatgtttttaaggcgtcaaaggatttttgcgatgtcttgtagatgtcgactgctctgactgcggctgacgtggcttgagtctcatcttcgccgttcttagcggctttaataatataacatttcgcttcattttatgtcaacaacttttttcaagtttatttcccgaagcgttttgtgtttgtcactgtgtgtcagcgacgattaataatatatcacgaaaacattctatcggtcaacgccttttcaaaactttttttgaaatagttttattgtgcatctcaaacccttgtcctgcatacaatcaagtaacaatctcggacaagtcaggagtgtttgaattgagtcgattatatgtgttgccaattaaacggctgaagcaagttgtcattattcttgtagcagcccttgcagctgcaacctttttttatgtacaaaaggcaccgccgctgtcggtatttaaaacagaacatgggccccgagccatttataaaggcgagacttcctcaaaacatgtctccctgacttttaatatcggctggggagatgagaaggcagtcccaattttaaatgtccttcgagagcacgatataaagaacgctactttctttctgtctgcttcttgggccgagcgtcatcctgatatcgtcaaacaaattagagaggacggccaccaaatcggcagccttggctatgcttataaaaattatagccagcttgaagatagtgaaatcaagcaagatcttgtccgggcacaaaattcatttcaaaagcttggactagatgacattcaactattaagaccgccaactgggcaatttaacgaaaaagcattaaaaattgccacacagtacggttataccgttatccattacagcgtcaattcacaggattggctgaatccaggcatcgatcagattgttcggaatgtaaatgatcgaatgaaaagcggagacattgttctcttccatgcctcagattcagcaacccaaaccgctcaagccttacccgctattttgaaacaaatcaaagagaagaatttaaaaaatgtgacggttggcgaactgatctccaataccaaaacaaggtcatcggaagttaagtagctttcgcctttgaaaaccgcggcatagctaataactgaaacgcattacagcctaatagcgggaatagcattaaatacagccagtcctcttcgttaactctaagcgccgggaaccattctagcgacgtgatgacaaccatgagaaacattgcggaaacaaatgttttcttagaggactgctgctgtttaaagtaagccacgatcaatgcgaacacaccgataaagacaggcagccataggtatggaagaaatgattcattctccccgaaaagcaaaaaccgcaagtaagctaaatcaaacagcacaaagatcaccagaaacagctgaatggtattccataaagaatgcgaccggaaaatctctaacgcaaaccggtgcaccgtcaaaaagacaacaaaccccatctggctaatgacactaaaaatcatccccacaccaatgaaccaaaacaacacagatgcgatttctagaatgtcaaacgatataaaaagcttctgatatttcccccactccagcgcaaagcctaccacgcttgtaatgaccgctccaacagctagcacagagaagaaaaaacgaactaaatcccgacttttcattgaattgatccaacccctatttttgttatgtataaatttacgtgaaacattcatattaaaagtaagacatgtatcgaaaggagccacagtatgtcaaaaggcatcttgcgtataatgagctgttttctccttttatctctaacagcttgtgctcccaaaacccaatcctcatctaatatggactatgacgaaacaaagaaaatggtcgtcgatatattgaagacagatgacggtaaaaaggccattcaacagttattaaatgacgaggcaatgaatgaagctttggtaatggatgaacaaactgtgaaaaaaacgatagagaaaacactgacttctgataaaggcaaagagttctggaagaaggtctttgaggattctaaatttgccgagactttcgcaaaatccatgcagcaacagcatgaaaagatgttaaaacagttaatgaaggaccctgactatcagcaattgatgatggatattctcaaggatcccgaaatggaaaagaaatacggtgaactggtcaaaagcaaagagttcagaaagcacttagaaaaagttattacggaaacattaagcagtcctctctataagaagaaattcgaagatgagctgaaaaaagcagcatctgaaagcagcagtgattccggttcacaaggaagcggcagttaaacatcacccgagtggcacaaggtccactcgggctttcattatgcttttactgctaattgttcaataactttattcgcaatgtgttgatacacttctcccgttggatgactcgcatcatagacggatggagcaaaatcatcttcattccaatcaggctgtcttaaagggatctgaccaaggactgatactcgcagctcctccgccagcttgtccccgccgccctttccaaaaacatattccttctcacctgttttcttgctttcatagtagctcatattctcaacgacccccagcacctcgtgatctgtttgcagtgccattgcgcctgctctagcagcaacgaaagcagctgttggatgcggtgttgtaacaatgatttctttacagcttggaagcattgtatgaatatcaagcgccacatctcccgttccaggtggaaggtctaatagtaagtaatctaattctccccactcgacttcgtggaagaagttatttagcattttaccaagcatcggccctctccaaatgaccggtgcattttcttcaacaaaaaagcccattgaaatcactttgacaccaaagcgttccacaggaataattttttcccctttaaccgttggtctgacggtgattcccatcatatccggtacactaaagccataaatatctgcatcaatcaggccgacttttttccctagacgggccagtgctacagcaagattgacagacacggtggatttcccaacgccgccctttccactcgcaatcgctaagaactcaggcggatttttagagttgagcaggttttcttcctcatcttgtgatggcataaacctttcaagagtttcctgaggcagttcttcaaaacgaagccctactgtgttagcgccctctgctttcaaagcttgtacgatgtcttgctgaagcttcatctgctcagcagtgcccgttttggcaatagccacctttaagctcacatgttctttttcaggttttaggctgatttccttgatggcatccagctcaccaagcggtatatgaaggaaaggttcgtccatcttcccaactagttttctcacatcatcttgtccgatcatagcagaacctcaccctttattgaattcgtttacaatccaagtatatcatacatatccttacaatgtctgtcctgtttgcctgcgttcaaaaggaaaaagccccttattcaggcggctctttttgctctgttaaatatcttaaaatgcctttataaatggaggcggctatttgatcttgatatttaggtgttgccagctgaccggcctctttcggattggagagaaatccaatctccacaagagctcctggctttgtgacattttgcattaaatagatgccattgatacgcttcgcctttcgatctgtgttttcaagattattgcgtaattcatcttgtatgaacttcgctgccttttcattctcttcatattttccgtaaaaaaacgtctgtgcgccgctccatttgttcgatgggatcgcatttaaatgaatacttaaatagagatccgcttcagactcattgatggcttttacacggtttcttaaatcctccgctttcttccgcgcatatccctttgtattctttgatgataaatcagaatcatcctcgcgggtcataagaacaagtgctccctgctcctgcaaatagtcacgtatcttcttggatacatccagtgcaatctctttttcaagcagttctcctcctacagccccgccatctggaccgccatgacccggatctaaatagatgatcttgccgctcagaggcaagttccacgatttccacgaatcatcatttagaaattgaaacctgaataagaataagaggacaataaacccgattaaaaaccctgtccatttcagctttcttttcatccctgtccctcccatacaccattattttatagatatgggacaagggctggaaatatgcttagtgcagccgaagcttatgccttttttctgattctcgaaagccttcctgccaccacatgcttaaaaaatccttcgcaaatggatacagacatgacatcttccgctccattcggaacatattcgcccacgattgcaaacaccctgctagctcctcagccagctcatcttcttcttgaactgatcgcttctttatatcatcgaacgattcaccgtacttgcttgactcaccgtatctcccaccagctaaaaaagcttcaatggcgaaatcgatacagccatcactcataatcccagctggatcatctgcaaatgggaacagcttcttcgtgaatttctcagaagcgaccgtcacctgttgaagagacaatgtacgcaacagcttcttttcaagcgtgacatctcgttttgttttcaattgataaaatgaaagaacctctgccatagactgaactccttttttctttgtattgttcgttggtttgaacaaaacatgcagttcagtaaatggaaatcaatgagctaatgggttggaaaattgtgataaaatgaacacttatatagaaagaatgaaaaaggggcaaaattcatgaagaagtggatgtatatcctattgctattaacagtcgtcttatctggatgcaacagtaaggcgaccgagcagaagagcgacataaaaggaatagaagacatatcattaaaacagctttccaaatacaaaaattcctatattggagacaacggagcaattggcgctattttatcaaatcttccaggtaacgtgattcgtgagtatgaaatcatagatgaaaaagagctaaaagtgacatatggcgtgaaagaaaatggcaattatacagaagaacaatttgatacattttggtttgacaagaaggataccattgaaaagaactacttatataacgtattggcactttttattcttatcgataatgctgagcaagtgacactcaagataaactctaacgacaaacaatccgtcacgtttaaaagacaagagctagaaaaaaggctccctcactcctttaaagagtacaaagacgatgcagcgctttggcaaaaggacctggttgatggagttgtgaagacaaaagagaagcgccaagatgtatataaagtgtttcccatgcagaaataataaaacagaggggtgtctccctctgttttttatgattatttagtaaaagcttgaattaattgttgtcgaaagttttggtccactgctgcagtcagtataaattcattgaatacttcctcaatccagtgagaattgtccgctttcggatcattgataaaaagagaaatggatatagatgagatatccgtttttcgatataaagcagcagtgacaacaaacaatgtcgatccacctttataccaaaaatattgatctgtttccgtcttcaatgtttctcccagcacaatttggctaaaaagacgcttttcttctgttgttaacagctcatcctgtagacgtttcataaaatgtgcatattgattagttgtagactttgtcattttttgcgtcagtaatgattgaatccgcaagcttaacaagtcttttttcatcaatttttcttctaacgcctttttatgctctgggtcatttttcatgatattaaaaatctcaatcatcagagatttgtattgtttatcagttacatcgctcaattgcttgaatgcattccgctcatgatcagatacataggctggccacaacagcttgggtgtcagcggcatgagttcatcatgttctgtaagacctgcttgtttcatctgatcattgatcttttctaagtcaagcaagtcaatcaaataatccgtacaagcattcgaactgaattgcatcatccctttggcaacatctagtaaagtcgcatgctcagaaaaatcattgacctcaagccagtacgtgtgtgcaccaccgtctgttctatcaataaaaaacttctctatatcagacaatgccactttttcatctagcttgatgtcaccgctagagacggttttaacaaaatgaaacaaaaccattaatttcatcgtacttgcaagtggtgttttttgatcaccattccaatctaataccacctcttcattttcaatcattgtcgctgatacgtcctttttgtttttcgtgacaaatgtcaaaagatcttcctttgttttattcaaatgtttctcctttcccaaccactatagattctcaccttcaatataacaaatatttgaaataaaggcacaaaaaagcaaaggattatgaatacctttgcttctttgtgtgtttattgacgatgaatttgcagcttcatcccatcatgcgtagcttcaaagcccaacttttcgtaaaaacggcgtgcatctgatctctgtttgtctgttgttagctgaatcatatgacagccgcggtcgcttgcatgttgaatagccttttttatcaacatcgtgccaattccttttcctctatgagtcgaggccgtacgaactccttctattgaagctctccatcctccttgatgtgtaagaaatggcgtcatgttcaattgaagaacaccgactgcttcttcctgatcacacgcaacaatgagttcaatattgggatcagcatctattgaatgaaaggcttcgatatagctttctaataatggttgcgtgtaatgctctcttttttgacctaacatatcatccgcgagcatgaagacgattttgtcgagatcatccagcttggcttctctgaacgtcagttgactgaaccccattgaacacacctcctatgaaattattgaccaaaataccattgatgtgcgttcttatataagatgtgatcagctgccttttcatcaaagagctgttgaatcaactcaacatcaccgtattcaaatggacgctttgctctagtggatggaaggtctgtaccaaacatcagtgcatcaggattcgtttgataaatggacgtcaatgcatgttcaacgtttaaatcgactcgtccaaaaccagttgcttttacccgaacccctttatcaaccagcttgagcaaatgcggcaaaccttcttccgacaagcctaaatgatcaatcgaaacggctggcagctgttcaagcgtagatgagatgtcagggagatgcttagcatctatgtagagctcactatgccatcccgccagctcatacacccttctcgcaaaataatcgagcttcgaaatatcctccgaaccgccccgcttcacattaaaacgtaaagccttcaccccatgttgatccaaatgaacaatctcatcatcagttgccgtaaaaggtaattgagtcacaccgcaaaaggctggacccagttcatccagcgccttcaacaaatagccttgatcaaagccttgaaatgaccctgagacaatggctccacctacaatccccagatcagccgtctctctcctataatcattcaccacataactaggcggtgtatacccttggttttcttgaatgggaaaatcaaaatcaatgatatgaaaatgtgcatcaaagatcctcatgcgcgcgcccctcttctgcttatttgatctgattatatcaatagcgaaagccaagggatatttggaatgacgaattacttcatatcaagaaaacttatcaagtttcccattcctcccgtaagatggcatagtaaaactcatcccaccactcatttccttgtggtatacattttttaaaatatccttctcttctcatccccaatttctccatcactctccacgatggcacattttcaggctgacaagtggcaataatccgatgtaaattcattgtgtgaaagccatgatgtagtacagcataagccgcttcagatgcatagcctttgttttgatatgcaggattgaagacccagccaatttcatatgtgtgatcaccaaagtaaggatgaaatgcgatatgcccgatacatgtatgatcttcttttaaaaggacagcaacatacttagcatcttcatgacgattatttttgacaaaactcttcgcatctcctttagaaaatacatcttccggaatatacttcatcacgaccggatcagatgtatatgcatagacatcctgccaatcatcatccgtaaatggtcgaatgagacatctttctgtcgttagattcataggacaacctccatcttttttaacagaaaacttctatactcatattttatacgtattcaagaggaagagaccagtcatgatctatcacataaaaagtacaaaaaaaagcaccagcacgaagctgatgctttttttataaggtttgtctgtaacaaacctttgtaaaacgtccatacaatataaaattgattaacgttttgagaactgaggtgcgcgacgtgcgcctttaagaccgtatttcttacgctctttcatacgtgggtcacgagtaagaagtccagcacgtttaagtgatgtacggtactcaggatctacttctagaagagcacgagagataccgtgacgaattgctccagcttgaccagagaatccaccaccgtgaacagttacaagaacatcgtagctgttagctgtttctgtgatgttcaaaggttgtttcacgtcttcgattaaagcagcgaatggaatgtattcagtaatttcacgattattaacgacgatacggccttcacctggaactaagcgaacgcgcgctacagaacttttacgacgacctgtaccgtaatattgaacctgtgccaaattgttaacctcccttataattaaccgcgaagttcgtaaacttcaggttgttgtgcttgatgtggatgctcagaaccacggtacacatttaattttttgaacatttgacggcctaatggaccctttggaagcatacctttgatagcaagctccaacattttttcagggtagtttgtacgcatctcaagagcagttctttgtttcaaaccacctgggtgcattgtgtgacggtagtaaattttgtccgtcaatttcttacctgttagttcgattttctcagcattgatgatgatgacatgatcacctgtatcaacgtgtggtgtataagttggtttgtgcttaccgcgcaaaagtgatgctacttcagtagaaagacgacctagagtcttgcctgccgcatcaacaactagccatttgcgctcaattgtgcttgcgttcgccattggtgttgtacgcatgagtttccctcctaaataaatcaatgaattttccttgaatcaaatgctacgttctatttcaaaacacaagataagtcttccggggcttatttgtggggttgaaatacataccatatgatatcttataactttctgcttcctgtgtcaagaacatgttacacctggtttagttgtcatagaaaacttcccataaatacagtccgtgactaggcgcagtcttgcctgccgcttcgcgatttcgggcggcaagcatagcttttatctcatcagggtggaatttaccagatccgatttcaagtaacgttccagcgataattcgcaccatgttgtataaaaagccatttcctctcacacgcatttcaaggccgtctgagacgttttcccactcaagggtgtaaatctccctcaccttgtcctgaacctctgtattggccgcacaaaagcttgtaaaatcgtgtgtgccaatgaggtgcccagcagcttctctcattttgtctgcatccagccggtaaggaaagtggcaggcatactgtctcgtgaacacattttggtgcgtttccgttgagaccttataacgatactccttcgaaacgacactaaaacgcgcatgaaacgattcatccacttcctcagcctttagaaccctgatgtcatccggcaggagactattgagggcaaaaggccatctttccatcgggatcgagagcggcgtgtcgaaatggatgacctgccccttcgcatggacaccgctgtccgtccggccagaagccacaatcggaatcagttcatcctgtttatgcattcttgcaagagccgactcgatctccgtctgtacagttcgctgcccaggctgcacctgatagcctttaaaatgtgtcccatcgtaggatacggtacatttgaccttcatctaggaatcacctaatttctcagaagcacaaggagtgctgttaacaggatgaataagagcagtgtgaacgtgtctttcatgccccagacaagctgacggtatttcgtccgaccttctcctccgcggtagcctctcgcttccatagcagtcgccagctcctctgcacgcttaaacgcactgacgaaaagcggaacaagtaagggaacgatggctttcatgcgatctttaagaggtccgcttgtaaaatcaacacctcttgccatttgtgccttcatgattttgtccgtctcttctagtaaagttggaataaaccgaagagagatcgacatcatgagagcaagctcatgaacaggcagtttgattttacggaatgggtgaagcagcttttccataccgtctgtcacttctataggcgttgtggttaacgtcagaagtgtcgtcatcatgatgagatagacaaaacggagagaaatgaaaatcccctgctttagaccttcttcataaatatttaaaaaaccaaagtgaaatagcaaagcgccatccttagtcataaaaatatgcagaataaaggtaaacaggacaatccataggatcggcttcattccctttagaataaagtatagcggcacctgagaaaccatcaccacaaggagggtaaagacacctaaaagcccgtaagtgatgtaattattagcaaaaaagacaataaagacaataaagaaaattgataacagctttgtccttggatcaagacgatggacaaaggatgtacctggcacatatttgccgataatcatactatccatcatgatgtcgtgtcctcctgataaagagctgttaaggcttctgccatttcatccatggtcagaagcggccttggaaacgtaatacccagcttttcttctacagtctgctggaatttaatcgtttctgggaggtcgagaccaaacgaagacatgtctgtacgattggcaaacaattctctcggcgtacctgtcgccttcaccgttcctttatgcatcacaatcatttgatccgcataatgagcagcatcctccatactgtgtgtaaccagaatcgtggtgaggtttgccttttgatgaagctcatagaacatgtccatgatttccttacgtccgcgtggatctaaccctgcagtcggctcatccagcacaagcacttccggttccatcgctagaacacctgcaatcgccacacgtctcatttgaccgccgcttagttcaaagggagatcgagataataaggattcaggaagaccaaccagcttcagcatttccttcgcctttgcttctgccttttcctgaggaacaccgaaattcattggtccaaagcagatatccttaaggatcgtttcttcaaagagctgatgctcaggaaactgaaacacgatgcctacttttttccggagggactttaaatccttctgctttttattggcttgtaagacggtatccccaagcgcaatgctccccttcgttggtttgagcaagccatttaaatgctgcagcaacgtggacttgccagagcctgtatgaccaatgacagcaacatagctgccctcttggatggaagcattgacatcatacaaagcgagacgctcaaacggcgttttcatttgataacgatgctctaattctttgatcgtaatgtccatagctctttcaccaatccttcttgtgtcaaatgggcatttgcaagcggtacaccttgctgcttcaattgtttgctcaaccgataggagaatggcagatcaagtccaatttgaactagctgttcgtctaattcaaaaacttcctctggggttccctcggcaaattttttcccgccattcatgacaatgacccggtctgccttggcggcctcgtctaaatcatgtgtgatggaaatgactgtgaccgttccttgttccttcagtagtctaacagtctctaacacttcttcacggccaatcggatcaagcatcgatgttgcttcatccaagatcatgatgtcagggcttgcggcaagtacgcctgcaatggcgactctctgcttttgcccgcctgatagatggtgcggctcttgatcaagaaactcctgcatattgacctgtttgacagcccaatctacacgttctatcatcaattcccgctcaaccccgttattttctaaaccaaaagccacatcatcacgaaccgttgagccaacgaattggttatctgggttttgaaagaccattccgacctttttgcggatatcccagacactctcttctttcagctcaatctctccaaccttgaccgttccagcatccggtaaaatgagcccattcagtacacgggcaagtgtggatttacctgaaccgttatgaccaacaatggcgagccattcattttgattcacatgcaatgacacttgatctaaagcgggcttgtccgcatccttgtgataacgaaatacaatgtcctttacgtcaattaatgtcttccccatctctaccggacctcctctcagctcaacctcttctttgcttcttgctaaaaagccgtagtatctaaaaaagggcatagatccagttatgaactgtcccgccctttcttagatacacgctatgtgattaaactaattcaatgacagccattggtgcgccatcgccgcgacgaggtccaagcttcatgatacgagtgtatccaccttggcgatcttcgtagcgagttgcaacgtcagcgaataatttttgaagtgcatcttggtttgtttcagcgttagctacttcattacgaatgtaagctgcagcttgacggcgagcatgaagatctccgcgtttgccaagagtgatcattttttcaactacagagcgaagttctttcgcacgtgtttcagttgtttcgatgcgttcgttgatgatcaaatcagtcgttaggtcacgaagcattgctttacgttgtgcactagtgcgtcctagctttctgtatgccatgtgatgtcccctccttagttagagaatgctgtatgaataaaaaacacacgaaaatcctagttcacaatgaaactagtcaatcgtctttacgaagacccagtccaagttcttctagtttcgctttcacttcttcaagagatttacgtccaaggttacgaactttcatcatatcctcttctgtcttgttagcaagctcttgaacagtattaatacccgcacgcttcaaacagttgtaagaacgaacagaaagatcaagctcttcaattgtcatttcaagcactttttctttttggtcttcttctttctcaaccataatttcagcatgctgagcttcgtcagttaacccaacgaaaatattcaggtgttcagttaaaatcttagaacctagagcgatcgcttctttcggtcctgtgcttccatcagtccatacatctagtgttaatttatcatagtttgtgatttgcccaacacgggtgttctccacttgataagtcacacgagatacaggtgtatagattgagtcgatcggaatcacaccgattggctgatcgtctcttttgtttgcatcagcaggattatacccgcgacctctttgtgcagttaagcgaacacggaagctcgcattcttgccaagagttgcgatgtggagatctggatttaagatttcaatatcgctgtcgtgtgtaatatcagcagctgttacagtaccttcatcttgtacatcaatttcaagcgtcttctcttcttcagagtagattttgagtgcaagctttttaatgtttaagataatcgttgtaacatcttcaaccacgccttcgatcgttgagaattcgtgtaagacaccatctatctggatcgatgttacagctgcaccaggaagtgaggataaaaggatacgacgaagggagttccctaaagtggtaccatatccacgctcaagtggctctacgacaaacttgccatacttggcatcgtcgctgatttcaaccgtttcgatttttggtttttcaatttcgatcatctaataaaaccctccttcaaaacgtcgaaacctcgaatagaatcatatgagattccatccgaaattcctcattgtttagtcccgtatgtgctcaggcaacgagtcgtgtattcgtctcataaataactgtatcataacccattattgacagggacacaaaatctatacaaacaaattacacgcggcgacgttttggtggacggcatccgttatgaggaactggagttacgtctctgattgcagtaacttcaagacctgcagcttgaagtgcacgaattgcagcttcacgaccagaaccaggacctttaacagttacttcaagtgttttaagaccatgttcgatagaacctttagcagcagtttcagcagccatttgtgcagcgaaaggagtagatttacgagaacctctgaatcctaatgcaccagcacttgaccaagaaattgcgtttccatgaacatcagtaatcgttacaatcgtgttgttgaaagtggaacggatatgagcgattccagcttcaatattctttttcacgcgacgtttacgcgtattttgtttacgagcagcagccattctttaactacctcctttacttattttttcttgttagctacagtacgacgcggacctttacgagtacgcgcgttgttttttgtgttttgtccacgaacaggaagtcctctacgatgacggattccgcggtagcttccgatttcaattagacgcttaatgttaagtgaaacttcacgacgaaggtcaccttctactttaagtttgtcaatgatatcacggattttaccaagttcgtcttcagttagatcgcgaacgcgagtgtcttcagaaacacctgcttctttaaggacttgttgcgcagtcgtacgaccaattccaaaaacatatgttaaagaaatgacaacacgtttatcacgtggaatatctacaccagcaatacgagccatgatttgggcacctccttgttattagccttgtttttgtttatgttttgggttttcacagatcaccattacttttccttttctgcgaataaccttacatttttcacagataggtttaacagatggtctcactttcatgtgtttccaacctccttcttccggagttgctttatttgtaacggtacgtaattctaccacgagttaagtcatatggagataattctaccgtaactttgtctccaggtaaaatgcgaatgaagtgcatacggatttttcctgatacatgagccaaaactgtatgaccattctctagttcaactttgaacattgcatttggcaaagtttctgctacagtaccttccacttcaattacatcgtctttcgccattcaagtgttctcccttcttcaaatcagtaacttgctctctgacaaatgtccaaatgagttcatctcaattgtccatctatcacccgacctgttttgaatatactgttctgaacttccggagatacgcaaccataaaggttatatgattgatattttttcttaggagaatgaaatttacgcttttctccgtctgcgattagtacatggcagccaccgaacatgccgatgacacctgtatactgatcttgttctttcctttggactatacagacaacctgcccgatttgggcctgaaaggcttcagtgaagacctaaatcttagtcagtatatcaaaacctgtatctgtaatcgcaatcgtatgctcaaagtgagcacactctttcccatcaaccgttacaaccgtccagttatcagccaatgttttcacatatcggctgcctgcgttcaccatcggttcgatggccaacaccattccaggttttagccgcgggcctttgttgggcggaccataatgagggatttgagggtcctcatgaagatcctgtccgaccccatgtccaacatattctctaacaactgagaaattctcgttttctacatacgtttgtatggcatgggaaatgttcgacagacgttcgcctggctttgcttcctgtaagcctttatatagagattcctctgtgacttccagtagtttgcggtcttcatcgctgattaccccaactggataagtccaagcagagtcaccatgatagccatttaacttcgcgccaatatcgatactaatgatgtcaccatcacgtaaaacccgtttaccaggaataccgtgaacgagttcttcattcaccgaaacgcaaatgctcccgcgaaaaccattataccctttaaaagatgggattgcaccctgctttgtaataaaacgttcggcaatttgatccaattcttttgtcgaaatacctggttttatatgtttcttcagctcttcatgagtcagtgcgacaatgcgtccagcttctctcataatctcaagctcgcgaggagttttacagataatcatttatttaatcccccaagcaggtccttgatatctgcatatacatcgttaatgtgttttgcaccgtcaatgtttgcaagatatcctttttctgaatagaagttcagtaaaggttcagtctgctttaagtttacttcaagtctagtcgaaacggtttctgcattatcatctgcacgttgataaagctcgcctccacacttatcgcaaacattttctttcgcaggtggattgaatactaaatgatatgttgctccgcaatttttgcaaattcttcggccagtcagacgctccatcaaagcatctttatcgactttaatattaatgacataatcaatcgttctgccaaggtcctttagaatgtcttctaaagcttcagcctgagcgactgttcgcggaaatccgtccagaagaaaaccttgctcacaatcatttttgccaagtctttctctaacaataccgattgtgacctcatcaggaacaagctctcctttatcgataaaggattttgcttcgagcccaagttgtgtctcctctttcatagcagcgcggaacatatctcctgttgagatatgagggatcccataatcatcaacaattcgttctgcctgagtgcctttaccagcacccggaagccccattaagactaagttcatttcggatttccccttccttacttagagaggttgggcaggagcccagccctctgttttatttcataaatccacggtagtttcgtttcactaattggctttcaagctgtttcattgtttcaagtgcaacacctacaacaatgagaagacttgtgccgccaatttgtgcagcggaaggtaatccagcgaattgaatgaaaaagataggaagtattgaaatcacggctaagaaaatggcgcccacaaacgtgagtcggtacaaaatgctcgtaattctatcttgagtcattttccctggacgaactcccgggatatagccaccctgcttttgcagattttcagccatttgttcaggattcacttggacaaaggcataaaaatatgtgaaagcaacaatcaatgctacataaatcgtcataccgattggcttagtatagtcaaagttgttggttatccaagttgtcacattattagttccgaagaacgatgcgaccgtctgcggagtaataatgaatgaaacggcaaagatgactggaatcacccctgctggattcactttcaatggaaggtgcgttgcttgactagcagagatttgtgcacggccagttccttttgaatattgaatcgcaatctttctcactgccatttgaatgtaaataacaccgataacaatgacaaggatagcaatgacaataagggcaattttcaggatttgcatgaacagctgtccatctccacctacaaactgctgagcgtacacttgttttaatgtttgagggatacctgcgatgataccggcaaagataataatcgaaataccgttaccaacgccgtgagcagtaatctgctctcccagccacattaaaaatgctgttcccgcagtgagtacgaccgcaattaagaggtacgttgaaacacctgggttttcaatcagcatgcctcctgccatattattgaatccatatgacattcctaacgcctggataaaacctagaacaattgtaaaataccttgtgaattgtgctaattttcggcggccaacctctccttgctttgaccactcagtgaacttcggaacaacatccatctgcaagagctgaatgatgatcgaagcagtgatatacggcataatccccattgcaagaatggagaattggaaaagtgccccgcccccaaacgtgttgaggatcccgaaaacactcatttgatcctgtgcctggagaacttcggcgttcacattaggcacagggatgaaagcacctatacgaaagacgattaacattaaaagagtgaatataatcttattccgtatatctttcacgcgcataaaattggagattgtcttaaacaagttagatcacctcggctgtaccgccagcagcttcaatcgcttctttagcagaagcagagaatttattggcttttacagttaattttttttctaatttaccgttgccaagaatttttactcctgcttttaacttgcttattgcaccagtctctagaagaagttcaggagttacttccgttccttcgtcaaaactgtttaatctgtctaagttgattaccgcgtaatctttacggttgatgtttgtaaaaccacgttttggaagacgttggaataaaggcatctgaccaccttcgaaaccagggcgtacaccgccgccagaacgagcgttttgacctttatgacctttaccagaagttttaccgttacctgatccaataccacgaccaacacggttgcgttctttacgtgaaccttctgaaggcttcaattcatgaagtttcatttgggcacctccttatcgattaaaaatgttttattgttctttaacagaaactaaatgagacaccttgttaatcatgccgcggatcgctgcattgtcttcatgtacgactgtttggtttgttttctttagaccaagagtacgaacagtgacacactgatcttctgggcgaccgattacactgcgtttgagggtaatttctaatttatttgccattattgttccctccttatcctaacaggtcttctacagattttccacgaagcttcgcaacgtcttcagcacgtttaagttcacttaaaccctgaagtgttgcgcggatcatgttgatcggtgtattagaacctagagatttagaaaggatatcagctagaccagcaagctcaagaaccgcacgcactgggcctccagcgataactcctgtaccttctgaagcaggcttcaatagaacgtttcctgcaccgaatcgaccgatgatttcatgtggaattgtagttccaaccattggtacttcaattaaattctttttcgcatcttcaacagctttgcggatcgcttctggtacttcttgtgctttaccagtaccgaaacctacatgaccgtttttgtcaccgacaacaactaaagctgcaaaacggaaacgacgtccacctttaacaactttcgctacgcggttaaccgtaactaagcgttcttctaactctaatttgctttggtcaatacgactcattcggatgtgtccctccttcttttattaaaatttaagtccagcctcacgagcagcttcagctagagcttttacacgtccatgatataagtatcctccgcggtcaaataccacgttagaaattcctttttcaacagcacgttttgcaacaagttcgccaactttagtagcagctgcagcgtcagaactattctcgatctttaactctttatcaagagtagaagcacttacaagtgttacaccgttaacatcatcaattacttgagcgtagatgttcttgttagaacggaaaacgttaaggcgaggtctttcagcagtacctgaaagtttcgcacgaacacgagcgtgtcttttaagacgagtagcgtttttgctagttttcgtaatcatccgagtcactcctttcttcacattaagcgatcttacttaccagtttttccttctttacggcgaacgaattcaccttcgtaacgaattcctttacctttgtaaggctctggagaacggacagcgcggatgttagaagctagagctcccacacgctctttatcgatacctttaacgactactttcgtttgagatggaacttcgacttcaactccagcctcaggaacgatttcaactggatgagagtatccaacgttaagaacaagtttgtttccagatttagctgcacggtaaccgacaccgataagttctaaacctctttcgaaacctttagatacaccttcaaccatgtttgcaattaagctacgtgttgtaccatgtaaagcacggtgttctttatgatcagacggacggcttacagttaagacgctgtcctcaattttaatttccatatcagggtgaaatgtacgagttagttcaccttttggtccctttactgtcactgtgttatcgttgtttgtcacagtaactcctgaagggatctcgattagttttttacctatacgagacataccaagcacctccattcatcttaaactttttttaccatacgtaagcaagtacttctccaccagcttgtttagcacgggcttctttgtccgataaaacaccttgtgatgtagaaataattgcgattccaagtccgttaagtacacgtggtacttcatttgatttcgcatatacacgtaaaccaggtttactgattctttttagaccagtgataacacgttcgttgttttggccatatttaaggaacatacggataattccttgtttgctgtcttcaacatattcaacgtcacggataaaaccttcacgctttaagatttcagcaatttctcttttgatttttgaagccggtacttctagcttctcatgacgtaccatgttcgcattgcgaatacgagtcagcaaatctgcaatcggatctgtcataaccattatttaataacctccttcccatttatggggattaccagctggcttttttaacgccaggaatttgtcctttatatgcaagttcgcggaaacaaatacggcaaagtttaaacttgcgaattactgaatgtggacgtccacaacgttcgcagcgcgtatactcttgaactttaaacttttgtttgcgttgttgtttcgcaatcatagactttttagccacgatttcgcctccctttcattgattatttctggaacggcatacctacttgagttaataactcacgtgcttcttcgtccgtattggcagtcgtaacgataacgatatccataccgcggacttttgttactttatcgtaatcaatttctgggaagattaactgttctttaataccaagcgtgtagtttccacgaccgtcgaaagatttcttagaaatcccgcggaagtcacgtacacgtggtaaagatacagaaataagtttatcaaggaaatcgtacatgcgctctccgcgaagtgttactttcgcaccgattggcattccttcacgtagacggaatccagcaatagacttcttcgcacgagtaacgacaggtttttgaccagcgataaacgttaattcttcaacagcagtatcgattgctttagcgttttgaacggcgtcaccaacacccatgttgatcacgattttttcgatttttggcacttgcattactgatttgtattcaaacttagaaactaatgcaggtgtaatttcttttacatacttttctttaaggcggttcatgagaaagacctcccttccttatttactatttatctagaacttgcccagattttttcgctacacggactttctttccgtcctcaactttatacccaacacgtgtcacttcacccgttttaggatcaagcggcataacgtttgatacgtggatcggcgcttcttgttcagaaattccgccctgagggttagcttgggttggtttagagtgttttttcacaaggttaataccttctactaaaacacggtcattcttagggaaagcagcaaggatgactccttgtttacctttatctttaccagagataaccactactttatcgccctttttaacatgcatttaatcgcacctccttgagtcgcggattgtattcattaaagtacttctggtgctagagaaacaattttcatatagttgttttcacgaagttcacgtgctactggtccgaagatacgagttccacgtgggctcttgtcgtcacggataatgacacatgcattttcatcaaagctgatgtaagatccatcgtttctgcgagctccgctctttgtacgaacgataactgctttcacaacttcaccttttttgacaacgcctcctggtgttgcttgtttaaccgtacaaacaatgacatcaccgatgttagccgtcttacgtccagagccaccaagaactttaatcgttagtacttcgcgtgcgccagagttgtcagctacttttaaacgagtctcctgttgaatcattaatgttacctcctttcggaaaaagaaatccgaactttattagataataacggcttcttcgacaacttcaactagacgaaagcgtttagtcgcagataaaggacgagtttccatcacctttacgatgtctccgatttttgcttggttgttttcatcatgtgcttttaactttttagagtatcttacacgtttgccataaagtgaatgctttttgtatgtttcaactacaacagtgatggttttatccattttgtcagaaacaacacgaccttgatacactttacgttggttacgttcgctcatgtttgcggggcctcccctctaattattatttattagcagcgatttctctttgacgaatcacagttttcatgcgtgcgattgatttacgcacttcacgaatgcgagcagtgttttcaagctgcccagtcgctaattggaaacgaagattgaaaagttcttctttaagagactttactttttgttcaatttcagcagtggtaaggtcacgaatttcattagctttcatttgattcaccaccaatttcttcacgttttacgaacttcgttttaattggcaatttgtgagatgcaagacgaagagcttcacgagcaacttcttcagacacaccagaaatttcaaataaaactttgcccggttttactacagctacccatccttctggagcacctttaccggaacccatgcggacttctagaggttttgctgtgtatggcttagaagggaaaattttaatccaaactttaccgccacgtttcatgtaacgagtcatagcaatacgagcagcttcgatttgacggtttgtgatccaagaagcttctagagcttggataccgtactcaccgaaatgtacttcagtaccaccttttgcacgaccacgcatttttccacgatgttctctgcgatacttcacgcgttttggcaataacatattattttcctccttccgcagtattcttcttagttggaaggacttctccacgatagatccatacttttacgccaagcttaccataagtagtgtcagcttcagcagtagcatagtcgatgtcagcacgaagtgtgtgcaacggaacagtaccttcactgtaatattcagaacgagcaatatctgcaccgccaagacgaccagaaaccattgttttgattccttgtgctccagcacgcattgtgcgttggattgtttgtttttgtgcacgacggaatgaaatacgattttcaagttgacgagcgatgttttcagcaactagctgagcatcaagatctgctcttttgatttcaaggatgttgatgtgtacacgtttgccagttaggctgttaagagctttacgaagtgcttcaacttcagatccgcctttaccaattaccatacctggtttagccgtgtggattgtgatatttacgcggtttgcagcacgttcgatttctactttagaaacagacgcgtcagacaaacgcttgctgatgaattcacggattttcaagtcttcatgtaagaagtcagcgtaatcttttcctgcgaaccatttagattcccaatcacgaatgacgccaatacgaagacctactggatttaccttttgacccacggattatccctccttcttttctgatacaacgattgtaatgtggctagtacgtttgttaattgcgctcgcacgacccatagcacgtggacggaatctcttaagtgttggaccttcgtcaacgaatgcttgtgagatcactaggctgttagcgtccaactcgtagttgtgctcagcgtttgcgatagcagattttaatactttttcaataattggtgaagcagccttaggtgtaaggtttaagatagaaactgcttctcctacttgcttacctcggatcaggtccattactagacgtgctttacgaggagcaatacggactgttcttgcgacagctttagcttgcatttaaaagcctcctctcattagcgtcttgtttttttatcgtcactagcatgacctttgtaagtacggcttggtgcgaattcgcccaatttgtgacctaccatatcttcagaaatgaaaacaggtacatgtttgcgtccatcatagacagcgattgtgtgaccgatgaattgtgggaaaattgtagaacgacgagaccaagtttttacgacttgctttttgtcagtttcattcaatttctcgactttagccatcaaatgatcatcaacaaatggtcctttttttaagctgcgagccattgtggaacctcccttcgtgattgaactacggtcctaaatgaaccgtagacaaccccgttacttgtttttacgacgacgtacaatgaatttatcagacttgttggttttcttacgagtcttgaatccaagagtcggtttgccccatggagacattggtgatttacgtccgattggagcgcgtccttcaccaccaccgtgtgggtgatcgttagggttcattacagaaccacgaactgttgggcgtacgcctttccagcgtgaacgtccagctttaccgatgttaattaattcgtgttgctcgtttccaacttgaccgatagtcgcacggcaagcagaaagaatcatacgaacttctcctgagttcaaacgtacaagaacgtatttaccttctttaccaagaacttgagcagaagtaccagcagaacgaactaattgtccacctttacctggttttaattcaatgttatgcacaactgtaccaactgggatgttgataagtggaagagcgttacctggtttgatgtcagattctggtccagaagtaacttcagtaccaacttggattcctttcggagcaagaatgtaacgtttctcaccatctgcatagtttacaagagcgatgttcgctgaacggtttggatcatactcgattgtagcaacgcgtccaggtataccgtctttatcacgcttaaagtcgatgatacggtattgacgtttatgaccgccaccttgatgacgaacagtcattctaccttggttgttacgtccgccttttctgtgaagcggcgcaagcaacgatttttctggtttgtcagtcgtgatttcagcaaaatctgaagtagtcatgccacgacgaccattactggttggtttatactttttaatcgccattttgaatttccctccttctttttaagatttacgcttcaaaaatttcgatttctttgctgtcagcagttaatttcacgatcgcttttctgcgacggctagtcataccagtgtagcgtccaacgcgtttagattttcctttgtagttttgaacgttgactttctcaactttcactccaaagatttcttcaacagcatctttcacttctgttttgttagctctgacatcaacttcgaacgtgtacttcttctctgtcattagatcagcagaacgttcagtaatgatagggcgctttagaacatcacgaggatctttcattatgcaagtccctcctctactttttcaaccgctgctttagtgatcagaagtttctcgtggttgacaacgtcaagaacgttgataccgttagcttcaacaactgttactccagggatgttacgagcagataaagcaactgtttcgtttgcatccgcagtgacgatcaacgctttcttctcgacagataatcccttaaggatgcctgcgaattctttcgttttcactgcatcaagagtcagatcttcaagaacgatgatgttgttgtcgattactttagaagacaatactgacttgatagccaagcggcgaacttttttaggtaatttataagaatagctgcgtggtgttggaccgaatacgataccgcctccgcgccattgtggtgaacggatagaaccttgacgagcacgaccagtacccttctgtctccaaggcttacgacctccgccacgtacttcagaacgagtttttactttgtgagttccttgacgtaaggaagctctttgcataagaatagcatcgaatactacgctttcgtttggctcaattccaaacacagaagcgtttaattcgatttcaccgttagtagaaccgttttggttaaataatgctacttttggcatgacttgtttcctcctttcctaagagagttatttagatttaactgcactctttacagttactagagattttttagctcctggtacatttcctttgatcaatagaagattgcgttctgcatcaactttaacgatctcaaggttttggacagtgatttgctctccgcccatacgacccggaagaagtttacctttgaatactcggtttggatcaacaggtcccattgaaccaggacgacggtgataacgtgaaccgtgagtcattggtccgcgtgattgtccgtggcgcttgatagccccttggaatcctttaccttttgatgttcctgttacatctacgatatctccatttgcgaaaatatcaactttgacttcctgaccaacttcatacgcatctaactccgcaccgcgtaattcttttacgaagcgcttaggagcagtttccgctttagcaacgtggcccttctctggtttgttagaaagcttttcacgtttgtcgtcaaaaccgatttggattgcttcatagccatccgtgtcagtagtcttcttttgaagaacaacgttagcagcagcctcaacaacagttacagggataagatcaccgttttctgcgaacacttgcgtcataccaatttttctacctaagattcctttggtcattagtcacacctcctataatatgtgttttctatttgaattaaagtttgatttcgatatctacaccagatggtaaatctaaacgcataagtgcatcaactgtttgtggagttggattcacgatgtcgattagacgtttgtgagtacgcatctcaaattgctcacgagaatctttgtacttatgcaccgcacgaaggattgtgtaaactgatttttcagttggaagcggaattggaccagatacactagcaccagaacgcttagccgtttcaacaatcttctcagcagattgatcaagaattctatgatcatatgcttttaaacgaatacgaattttttgttttgccattattttccctccttttcgcctacttacgttagacagttctccgtgagaaaaacctgatcaccttgccatggcaaagcggccgggtgtgtcagcaacctctcacttcatcgcagtcaaagaccaacatgcactattgtaccaaattggcctgcgtgttgcaataataaatcggataaatttatgatttgcacacttttcatattatacaggggttgaacctataaatcaagctttccctgaagatgatgtacagcagtcttttttatggtacgaataaattcttctggttcttctagatgcggggaatgtgcagattctttaaaggtgaaccattctttgattggtgctgttaatttctcaacatatggttttgatacagcagctggtgtaatcatgtcatattcaccaatgataaagtaacaaggtattaatatagtagaaactcggtattcaatgctctcattcatcaattcatcccatagcatgtcctgactaagcttctgtcctttcaggaaattccacttatctttgagctgatatgtcttactaaaaagaaacccgcgcagcatttgaatcagcggcctccacttgtgtgtgaaacctacgcttccgagctctttatatagagagaacagagcatgagctgatattcgtttccacggaggaggcgtcagtaatcgcaaacaccatgtaaacaaccgattacgatggtatttcttcaaaagaagctcgtacgacacaatatcctcttttaatacatctactacctgactaattccataataagcatgatataaatctgggcgtttatgtactgcttgtatggcgattaatgacccccatgaatatccggcgatgtacagttttgattgacctagatatgaaaggaccttctctgtgagttcaatcgtatcttcaataaattgctgaatggtcatggagctatcggggagatacttttgataggaaagtcccgcacctcgctgatcccaatgaactactgtaaaatcctgcttaagcccctcatgaaacgaatcaatataactgatttgagcggagccgggcccaccgtgtacaaataatagaacaggcttcgtttcacttgtgtgatcttctttgatcataatccattggtcaactccgccgattaaccatttcttcaaatatgtcttcgccattccagtgatcctctcggttccatttagattctatagcttatagtagccgttctgatctggaaaagcaaaaaaagagacccttttgcaaggagtctcttttatatgttttattacttaatgatagttgaaacgacgccagaacctacagtacgtccaccctcacggatagagaaacgagttccttcttcgatagcgatagtagagataagttcaacttccatctcagtgttatcgccaggcattaccatttcagtaccttctggaagatgtacgataccagttacgtcagttgtacggaagtagaactgcggacggtagttagcgaagaatggagtatgacgtccaccctcttctttagaaagtacataaacttcagctttgaaacggctatgtggagtgattgtacctggtttagcaagtacttgaccacgttggatatcttcacgagatacaccacgaagtaatgcaccgatgttgtcaccagcttcagcatagtcaagaagcttacggaacatttcaacacctgtaacagttgttttaccattgtcttcttgaagaccgatgatttcaacttcgtcaccgactttaacttgtccacgctcaacacgaccagtagcaactgttccacgaccagtgattgagaatacgtcctcaactggcatcatgaatggcttgtcagtgtcacgctctggagttgggatgtactcatcaaccgcgtccataagttcaaagatttttgcttcgtaatcagcatctccttcaagagctttaagagcagaacctttgataactggaacatcgtcaccagggaagtcatagtcagaaagaaggtcacgaacttccatttcaacaagttcaagtaactcttcatcgtcaaccatgtcacatttgttaaggaatactacgatgtatggtacacctacgttacgagaaagtaggatgtgctcacgtgtttgtggcatcggaccatcagcagcagatactactaagatcgcgccgtccatttgagcagcaccagtgatcatgtttttaacgtagtcagcgtgtcctgggcagtctacgtgtgcatagtgacgagtgtctgtttcatactcgacgtgtgaagttgagattgtgattccacgctcgcgctcttctggagcaccatcgatttggtcatatcccatagctgatcctttaccagacttcttatgaagaactgttgagatagcagcagttagagttgttttaccatggtcaacgtgtccaattgtaccaatgttagcatgcgatttggaacggtcgaatttttctttagccattctaaaaatcctccttaaaggttcattgtatttggtatagagtgatagaaagtgaagagttacctctcactttctgatcttcaatagtagttatactttagtttaaaggcaaaatcaattattcacctttattttttttgatgatttcttcactaatgctcttaggcacttcttcgtagtgatccatgtgcatagtgaaagtaccgcgtccttgtgtgttagaacggagtgaagttgcatatccgaacatttcagaaagtggaaccattgcgcgaacaacttgagcgttaccgcgagcttccataccttctacacgtccacgacgagatgtgatatcacccatgatgtctcccatgtattcttcagggataacgacttccactttcatcattggctcaagtagaactgggttacatttgctaacagcatttttcaatgccatagatgcagcaattttaaacgccatttcgttcgagtcaacatcgtggtaagatccatcaaataatttagctttgatgtcgattaatgggaatccagctaatacaccattttcaagtgaatcttcaagacctgcttgaatagctggaatgtattcacgaggaacaaccccaccgacgattgcattttggaattcgaagcctgcgccttcttcgtttggttcgaattcgatccaaacgtgtccgaactgaccacgtccaccagactgacgtacgaatttaccttcaacttttgcaccagaacggaatgtttcacggtacgcaacttgaggagctcctacgttagcttcaaccttgaactcacgcttcatacggtcaacaatgatatcaaggtgaagctcacccataccagagatgatcgtttgaccagtttcagggtttgtttgtgtacggaatgtaggatcctcttcagctagtttagctaaagcgatacccattttatcttggtcagcctttgatttaggctcgattgctacatcgataactggctctgggaattccatagactcaaggataacagtatctttctcgtcacaaagagtgtcaccagtagatgtatctttaagaccaacagctgctgcgatatcccctgcatatacagtagagatttcttcacggctgtttgcgtgcatttgaaggatacgtccaacacgctcacgcttgttcttagaagagttcttcacgtatgaacctgaagcaagtgttccagagtatacgcggaagaaagttagtttcccaacataagggtcagtcataactttaaatgcaagagctgcgaatggtgcgtcatcagtagactcacgaacaacctcttcattagaatctggcaggatacctttgattgcagcaacatcagttggtgcaggaaggtaatcaagcacagcatcaagtacaagctgaacacctttgtttttgaaagcagatccaacaagaactgggtagaattcaacattcaacgttcctttacggattgcagctttcaattcaggaattgtaatttcttcaccctcaaggtatttttccataagctcttcatcaagctcagcgacagcttcaataaggctgttgcgaagctcttcagctttgtctttatactcagcaggaatttcttgtgcatcagagcgagttccaaggtcatcttcgtagaagtatgctacgttatctacaaggtcgatgattccttcgaattgatcttcagcgccgatcggcaattgaattgcatgagcgttcgcttgaagacgatctcttaatgtgcttacagagtaaaggaagtccgcaccggttttatccattttgttaacgaatacgatacgaggtactccgtaagttgttgcttggcgccaaactgtttcagtttgtggctctacacctgattgtgcatcaagaactgctaccgcaccatcaagtacacgtaaagaacgttcaacttcaacagtgaagtctacgtgtcctggtgtatcgatgatgtttacacggtaacctttccattgtgctgtagtagcagcagaagtgattgtaataccacgttcttgctcctgctccatccagtccatttgggaagctccttcgtgagtttcaccaattttatggatacgaccagtgtagtataagatacgctcagtcgttgtcgttttaccggcatcgatgtgagccatgataccaatattacgagttttgtctaaggagaactctcttgccattgggtaatttctccttccttattagggaatagtttttttagtttggtataaatcctaccagcggtagtgagcgaatgctttgttcgcttctgccattttgtgtgtatcttcacgtttcttaacagcagcaccagtgttgttagctgcgtcaaggatttcgttagcaagacgctcttccatcgttttttctccacgaagacgagcgtagtttactaaccagcgaagacctaaagtagtacgacggtctgggcgaacttctacaggaacttggtagttagctccacctacacgacgtgctttaacttcaagaactggcatgatgtttttcaaggcttgttcgaaaacctccatcgcttcattaccagtacgttctttgatgatatcaaatgacttgtagagaattgtttgtgactttcctcttttaccgtcgatcatcattttgttgatcaaacgagatacaagtttagaattgtaaattggatctggcaatacgtctctttttgctacaggacctttacgtggcatctgatagcctcccttctcatttaaaaggatttctatctgtctctcatctcaatatcattgtcagttgcctgactccactgatctgatatcaacttctaaaaacccttatgtttgtttgtattatttgctttgtttagggcgttttgttccgtatttagaacgtccttgcatacgaccgtcaactccggcagtatcaagcgcaccacgaacgatgtggtaacgtacacccggtaagtcttttacacgtccgccacggataagtactacactgtgctcttgtagattatgtccgataccaggaatgtaagctgttacctcaatcaggttagacaaacgtacacgagcatatttacgtagtgctgagtttggttttttcggtgtcattgtaccgacacgagtacaaaccccgcgcttctgtggagatgttacgttagtgtgctcttttttgaaactgttgtatcctttgttaagtgcaggagactttgagttttcaactttactcacgcgtcctttgcgtattagctgattaattgtaggcatgttgttattcctcccttcgttgctttttttataacccacatacccaggtggttcattaaaaggcaaaaaacaatgcttttgcatttacacatgcaaaaacaaaacaagtacgctataacataatggcaacagctgctgccccaacttcaattccgcaggctttgccgagctttttcatggaatctaccactagaatgtctacacccttctcttgcgctagttttgttacactagctgttaaagcaggatcagcatctttcgctacgacgatttcctttactgaatctcgtttcagagcttttactgtttgcttcgtaccaataataatggattgggcctgtgatactttatcataagacatcgaatatcctccaaagtaacaggttttattttgagcaccttggttatattatcatcatggcagaaggatgtcaatatcatatgacagattatcttgacatccttcaccattttttgatgattttataggaatctcacgagaaagattactctacaggaaccatatcgtcagacggctgcacttgtgaaaccggcttaactttacggtaatttggcattcctgttccagctggaacaagtttaccgatgataacattctctttcaagccaagcagttcatcacgttttcctttgatcgccgcatctgttaggacacgagtcgtttcttggaaggatgctgcagacaagaatgagtctgtttcaagcgatgcttttgtaataccaagaagaactgggcggcctgttgcagggcgcttgccttcgaatagtacttttttgttcgcatcagtgaattgatgtacatcaagaagtgtgcctggtaatacatctgtatcccctgcatcagcgacacgcactttacgaagcatttggcgaaccattacctcaacgtgcttatctccgatttctaccccttgcatacggtatactttttgtacttcatgaagcagatattcttgaacagctgtcatgtcagtcactttaagaagttctttcggatcgatcgaaccttctgtcagtacttgaccacgagtgactttatcaccttcaacaactttcagacgtgcattgtaaggagctgtgtaagaacgagtttcaacgtcgccttgaaccacaatttcctgctgcttgtcacgaacatcgttaatttcagcaacaacaccatcaatttcagaaatggtcgcttgccctttcggattacgcgcttcaaatagctcttggatacgaggtaaaccttgtgtgatatcgtctcctgctaccccaccggtgtggaacgtacgcattgtaagctgtgttcctggctcaccgattgattgagcagcgatgattccaactgcttcaccgacttcaacgtcagtaccagttgcaaggttacggccgtagcatcgtttacatacaccatgaggcgtgttacatgtaaatgcagaacggatccatacttcctcaattcctgcttcaactacttcaagtgctttatcttcatcaattagttcgttttcgccaacaatgacttcgcccgtttcaggatgaacaattggttttcttgcaaaacgtccaattagacgttcttcaagtttctcaataatttcatttccttctctaatggacttcgccaagataccacggtctgtaccgcaatctgtttcacggatgataacatcctgtgcaacgtcgacgagacgacgcgtgaggtaacctgagtcagctgttttaagggctgtatcggcaagacctttacgcgctccgtgagtcgaaataaagtattccaatacggttaaaccttcacggaaactagatttgatcggaagttcgataatacgtccagccgggttggccatcagaccacgcataccagccagctgagtgaagttagatgcgttaccacgcgctccagagtcactcatcatgtagattgggttgacttcatcaagggacttcatcagtttaccttggatgacatctttagaagaactccagatcgaaatgactctctcgtaacgctcttcttcagtaatcaaaccacgtctgaattgcttcatgacgttatctacttttgcttgcgcttcttcgaggatcttctgtttatcatctaatacgacgatatcagacaccccaaccgtaatacccgctttagtagagtatttgaaaccaagatttttcatgcggtcaagcattttagatgtctcagtgatatggaatctcttaaagatttccgcaatgattttacctaaaataccttttttgaacggcgcattgatttcttgtttctcgatcgccactttgacatcttcacctttttcaaggaagaagcggtcaggcgttttttcttcaatattgctctttgtcggctcattcatgtaagggaatgattccggtaagatttcgttaaagatcagttttccaactgttgtaatcaacaatttagaacgctgttcatcagtgaatgtcacattcttcaacgagttagctgcaacagctacacgtgtatgaagatgcacatacccattttgataagctagaagggcttcgttcgtatctttgaagaccataccttctccgatagcacctttacgctcaagtgtaaggtagtagttaccaagcaccatatcctgagatggcgtaacaacaggttttccatctttcgggttcaaaatgttttgagcagcaagcattaagatacgagcttcagcttgagcctcagcagataatggtacgtgaaccgccatttggtcaccgtcaaagtcagcgttgtaggctgtacatacaagtggatgcagacgaattgcgcgtccttccacaagtgtaggttcaaacgcttgaataccaagtctgtgaagagtcggtgcacggtttagtaagactgggtgctcgcgaatcactgattctaaaacatcccatacttccggctgcacgcgctcaattttacgcttcgcactcttgatgttgtgagctaaacctttttcaacaagctccttcatcacgaatggtttgaataattcaagagccatttctttcggaagtccacactgatacattttcaaatgtggtcctacgacaataacggaacgtccagaatagtcaacacgtttaccaagcaagttttggcggaaacgtccttgtttccctttcaacatatgagaaagagatttcaatggtctgtttcctggtcctgttactggtcggcctctacgtccattatcaatcaaggcatcgacagcttcttgaagcatacgcttctcgttctgaacgatgatgcttggcgcgccaagatctaataaacgtttcagacgattgttacggttgatgacacgacgataaaggtcgtttaagtcagaagtagcaaaacgtccaccatcaagctgaaccattggacgtaattctggcggaataaccggaagtacatcaagaatcatccatgatggtttgtttcctgagttacggaaggcttctagcacttcaaggcgtttaatcgcacgtgtacgacgctgtccttgagcagttttcagctcttctttcagtgtatctacttctttgacaagatcgatatcttgaagcagtttattgattgcttctgcacccatagctgctgagaatgtattaccgtatttatctaaataagcacggaattccttctcagaaagaagttgtttcttctcaagcggtgtgttgcccggatctgtcacaacgtaagaagcgaagtaaatcacttcttctaacgcacgtggtgacatatcaagaacaagacccatacggcttgggatacctttgaaataccaaatgtgggaaactggggcagccagttcaatatgccccattctctcacgacggacttttgcccgtgttacttctacaccacaacggtcacacacaacacccttataacgaacgcgtttatactttccacaatgacattcccagtctttttgcggtccgaagatacgttcacaaaagagaccatccttttcaggtttcagtgtacgatagttaatcgtttcaggctttttcacttcaccaaaagaccaagaacggattttatcaggtgatgcgagaccgatgttcatatactcaaaattgttcacatctagcaaggggcctacctcccttttaatcttcgggttataccctagtcacttgctctaatcgtttctgctattcttttgtgactgcgtcacgttcaagatcgacaggtgcgaggtctgcagcatcttcgtcattagataacgctaatccgtctgctttcttcgtttcctcatcgtcttctaaatctctcatttctatctcttcttcatcgccagataggattttgacatccatacctaaactttgaagttctttgattaacactttgaatgattcagggacacctggttcagggacgttatcccctttgacgatggcttcgtatgttttcacacgacccacaacgtcatccgatttaactgttaagatctcttgaagtgtgtatgctgcaccgtaagcttcaagtgcccatacttccatctctccgaaacgctgaccaccaaactgtgctttaccgccaagtggctgctgcgtaacaagtgagtatggaccagttgaacgtgcgtgaagtttatcgtcaaccatgtgagccagtttgatcatgtacatgattccgactgatacacggttatcgaatggttcaccagttcgaccgtcataaaggactgttttcgcatcacgggacatacctgcttcttcaagcgtttcccaaacatcttcctcacgcgcaccatcaaatactggtgacgcaatgtggatgccaaggtaacgtgcagccatacccatatgaagctcaagtacctgaccgatgttcatacgagatggtacccctagagggtttaacatgatatcaatcggtgttccatctggaagatacggcatatcttcttctggaaggattttagagataacccctttgttaccatgtcgtccggccattttgtcaccttcagaaatcttacgcttctgaacgatgtatacgcggactaactggttaacacccggaggtaattcatctccatcttcacggttaaagactttgacgtcgtggataattccgccgccgccgtgtggaacacgtagagacgtatcacgtacttcacgagccttttcaccgaagattgcatgtaatagacgttcttcagctgttagttcggttacacctttaggcgttactttccctacaagaaggtctccgtcttttacttctgcaccgatacggatgattccacgctcgtcaaggttgcgtaaagcatcttccccaacgtttggaatatcacgagtgatttcttccggtccaagctttgtatcacgagcttctgattcatattcttcaatatgaatcgacgtgtagacgtcatcttttacaaggcgctcactcatgatgatcgcatcctcgtagttataaccgtcccaagtcatgaagccgaccatgacgttacgtcctagagccaattcacctttttccattgaaggaccgtctgcaaggatttctccttttacgacttcatctccaacacttacgattggacgctggttgtagcaagtcccttggttagagcggacaaatttcagcaagctgtatttgtctaggtttcctttgacttgttgtccgtcgacatcttcatagcggcgaacccaaatattttttgcttcaacacgttctacaacacctgggtagcggcagatgacagcagcaccagagtctttacctgatacatactccatacctgtaccaacaatcggtgattccggctgcatcaaaggcacagcctgacgttgcatgttcgctcccattagagcacggttagagtcatcgttttctaagaatggaatacatgctgtcgctgcagaaacaacctgctttggcgaaacgtccatgtagtcaacgcggtttcgaggaacaacggtgttttcccctctgaaacgagcaatgatattatcatcgataaacgaaccatcatcagctagaagagcgttcgcttgtgctactacgtagttatcctcttcatcagcagttaagtagtcgattctcggtgtcactttacctgtttcaggatcaaccctgcggtaaggtgtttcaataaagccgaaacgattcacttttgcaaatgaagatagagagttgatcaaaccaatgtttggaccctctggtgtttcaatcggacacatacgaccatagtgagagtagtgaacgtcacgaacttccattcctgcacgctcacgtgtcaaaccaccaggcccaagcgctgacagacgacgtttgtgcgtcaattcagcaagcgggtttgtttgatccatgaactgagaaagctgagaactaccaaagaactctttgatagaagcgatcacaggacgaatattgattagttgctgaggtgtgatcgtgtttgtgtcttggatcgacattctttcacgaacaacacgctccattctgcttaaaccaatacggaattggttctgcagaagctcacctacagaacgcaggcgacggttaccaaggtgatcgatatcatctgtgtcacctacaccatgaagaaggttgaagaagtaactgatcgatgcaatgatgtcagaaggcgtgatgtttttcacagcttcctctacgtatgcattcccgatcacgttgatcacttgctcgccttcttgatcagacggtgcataaatcttaatagattgaagttctacttcatcttctactacgccaccatttggatatagctttctaaatccgatgccgttttctaagtatggaagaactttatcaagaactcttctgtctaaaatttgacctttttctgctagaatttcacctgtttcagggtcaactaacgtctcagccaatttttgattgaacagtctatttttaatatgaagctttttattaatcttgtagcgtccaacatttgccaggtcatatctcttcggatcgaagaagcgagagtctagcaggcttttcgcattttcaacagttggcggctctccaggacggagacgctcgtagatttcgagaagtgctttatccgcattctctgtattgtctttttccagcgtgttgcgtaagtattcattctcgccaatgaggtcaagaatctcttgatcagagctgaagccgagagcacgcaaaagaaccgtaaccggcaacttacgtgtgcgatcgatgcgtacatagactacatccttcgcatcagtttcgtattctaaccatgcgccacggtttggaatgacagtcgcagtaaaaccttttttaccgtttttgtctactttaccactgaaatatacacttggagaacgtactaactgagaaacgattacacgttccgcaccgttaatgataaaagtacctgtgtctgtcatgattgggaaatcacccatgaacacatcttggtcttttacttctccagtttctttgttaattaaacgaacttttactcttagtggagcagagtaagttacatcacgttcttttgattctgctacaggatacttaggatcccctaggctgtaatcaatgaattcaagagaaaggttaccagtaaaatcctcaattggggatatatcttgaaacatctctctaagaccctcatcaagaaaccactgataagaagaggtttgaatttcaatgagatttggtaattctaacacttcgcttatgcgtgcgtagcttctgcgctggcggtgtcgtccatactgaactagttgacctgtcaactgattcacccctcaaatcatgcgtattatatgtgtaaaaagtatttcagcctttcaaatgtcagtaaagaaatacttttacaagacaaaagaaaaaagggtttctaaaataagaaaaccacatccaaaaacaaataccgattttattagttttcccaagtatgcataatttatacaaaatagttgttttttaagcctatcaagcaaaatatacacattggcattttataatgttaacacagctaggaaactgcgtcaaacttttttagctttgataatatagtagcccttttttttcaatacaacttcgacttctccaaagagctgttctaatttctcaatcgcagatggtccgccctgctttttctgaataaccacccacaactcaccttccggcaataaatgatcagcacttttttcaaagatcgcatgtacaactttcttccctgcccgtattgggggattggtcagtatagaggcaaaagcagctgatgaatgaacattcgagaacaaatcactttgatagatgcggacattatcaatgcgattatgtttagcgttttcctttgaaagttcgactgctctttcgttcacatcaatcatatgaatggtgcggctcgtcatttcgtttgctaacgataagccaatcggtccataaccgcaaccgacatctaagacatcgccacccacgtcaggttcttcaaaagcttcaattaaaagcctcgaaccaaagtcgacttctttcttagaaaacactccactgtcacttgtaaaagtataggtacggtttctcaaggtgaagtcccatgtctgtttattgcttttcactgatggcttttccgtataatagtggtcactcatggtgaattggacctcctctggattcaatcgtttcaggagaatagaaaagaaaaagcccgccagtaaaagcgagctttcccaaaagattaggcgaagattacttaacttctacagaagcgccaacttcttcaagcttagctttaagttcttcagcttcttctttagcaataccttctttaagtggttttggagtgttgtcaacaagttctttagcttctttcaagccaagaccagtgatttcacgaaccactttgataactttgattttttgatctccagcaccagcaagtactagatcaaaatcagttttttcttcagcagcagcaccgccaccagcagctacagctacaggagcagcagcagttacgccaaattcttcttcgattgcttttactaagtcgtttaactcaagtacagttgcttctttaactgaagcaatgatttcttcgatatttaaagccatttgtaattcctccattttaagttttttacgtcaagtacgcattaagcaccttgttcttctttttgatctgcaactgctttagtagcaagagcaaggttacgaactggagcttgaagaacgctaagcaacatagatagtaagccttcgcgagacggaagttccgcaagagccttcacttcttctacagtcgctacgtttccttcgatgacaccagctttgatttctaaagcttcgtggcttttcgcaaattcgttgatgattttcgcaggtgcgataacatcttcgttactgaatgcgatagcgtttggacctgttaagaaatcgtttaaacccgttagttcaacttgttcaactgcacggcgagtcaaagtatttttgtaaactttgaattctacgccagcgtcacgaagctgtttacgaagttcagtcacttcagaaactgaaagaccgcggtaatctacaatgacagtagacatactatctttaaatttagaagtaatttcatcaacgacaactttttttgtatcgattgcattgctcatggttacacctcctgtacattgtttgtgtaacacttataccgatcaggccatcacgttcctaacgaacggttctccatataaaaagcctccattaagacatggaggctgtatatacaagcatacgttaacgtaagactgtgacatatacacctcggcgggttaattaagccataaggcccctgctgtctacggtataaatggacatattctattttacaacattttgatattatcaaaatgattgtgataagtcaagatttattttgcagagaaagaagatggatccactttcacgccagggcccatagtagatgtaacagaaacgtttttcacgtatacacctttagccgctgcaggttttgctttaaggattgtgtcatagattgttgcaaagttctcaacaagcttttcgtcctcgaaagaaacctttccgattggcgcgtggatgttaccagctttatcaacgcggtattctactttaccagctttgatttcattgattgctttttctacttcgaatgtaacagttcctgttttagggtttggcataagaccttttggtccaagtacacgaccgatcttaccaacttcacccatcatgtcaggtgtcgcaacgattacatcgaattcaaaccagccttgttggattttagtgatgtaatcagaatctccaacgtagtctgctccagcagcttctgcttcttttgctttttcgcctttagcgaacacaagaacgcgttgagttttaccagttccgttaggaagtacaactgcaccgcggatttgttgatcgtttttacgagggtctacgcccaaacgaaaagcaacttctacagtcgcatcaaatttcgctgtatttgctttttttgtaagagaaacagcttcagctacatcatacgctttagtacgttcgatcagcttagcagcttctacatactttttaccttttttagccattataaaaatcctccttatgtggttttagcggaataacctcccacgaataagggttgcgaacttgtcaaaaccaaactcgcaacccaacaagacaataaattaatcttcgatgacaatacccatactgcgtgcagtaccttcaaccatgcgcatagctgattcaacgctagcagcgtttaagtcaggcatttttgtttccgcgatttcgcgtactttatcacgcttaacagttgccactttattacggttaggttcaccagaaccagactcaataccagctgcttttttaagtaaaactgcagcaggtggagttttagtaataaatgtaaatgaacggtcttcaaaaaccgaaatttcaacaggaatgataagaccagcttggtcagctgtacgagcattaaactccttacagaatcccatgatattaacaccggcttgacctagtgcaggtccaactggtggagctgggttagcttttccagcaggaatttgcaatttaacaactttaactacttttttagccacgagacacacctccttaaagtccgtgatgtggtaataggggaatccccctcccactcaacaacttcattctttatatgaatgacgaaataactagctagcgatcttgagcgaactcaagacgtacctttgctatattaccacttctatacactcatttcaagctcttttgaattacaatttatcgatctgcgtgaactcaagttccacgggtgtttctctaccaaacatattaacgaatactttgactttgcttttatcgtaatcaatctcttcaatagagcctgtgaagttagcaaatggtccgtcgatgaccttgactgtttctttcaattcaaagtcgatttctgttttgcgttcttcaaggcccattctcttcagaatggtttcagcttcgcctggcagcagcgctgtcggcttcgagcctgatccagctgatccaacgaatcctgtgacacctggtgtattacgaacaacataccaagagtcgtcagtcatcacgatttccactagaacatagccagggaatactttctttttgacaacttttttcttaccatttttaatatctgtttcttcttcttctggtacgacaacgcggaagatcttatcttgcatgcccattgattcaacacgcttttccaagttcgcttttactttgttttcatagccagagtacgtatgcacaacataccaattcttttccatttcgttcaggactattcagtccttccctccccacatttcgtaatgtctatttgacgaatctcgagtaccggtaaatattttcaagcaattgaaaaaacccgtaaaacgggttttttggcaagtcatattatgatctattatagcacgttcagcagaccattattcaagtattaatgaattaattcgattaattgtgagattcctatatcaagaaaagagaaaaagattgcaaagaatacgactgttaaaataacagtgattgtgtaacgaatcatttcgtttttctttggccagctgaccttcttcatttcttttccgacactttttaagaaactgataatacgcattgtaaaagacctccacagattaaagaacgcaaatcttacttcgtttctaaatgtgttttatgtgaattacaagtcttgcaatatttcttaacttctaatctttcagctgctgaagcatcacttttcattgtcgtataattgcggcttccgcagtctttacaggctagagtaatctttttcctcatatttacacctattttctcgacatcatttccttagtaccttatcacagtgtcgaaaaagctgtcaatataggtttgattagagactaatctcgcgaagctctaaatatttctctaattttctctttactctttggagtgcgttatcaattgatttcacatgacggtttaaatcttcagaaatctcttgataggatctgccatcaaggtaaagcacaagaacctttctttccagctcgcttagtagttcacccatcttcatttcgatatcatcaaattcttctttgctaatgattaaatcttctgggttaagcgctttagcaccggaaatgacgtccaacaatgttctgtctgattcttcatcatatattggcttatctaatgatacataggaatttaacgggatatgtttttggcgagtagctgttttaattgcggtgataatttggcgggtaatacataattctgcaaaagccttaaatgaagtaagcttgtcctctctgaaatcgcggatagacttataaagtccgatcatcccttcttggacaatatcctctcgatccgctccaatcaagaaataagatcttgcttttgcacgtacaaaattgcggtatttcgttattaagtaatctagcgcatcactatctccgacatgaaccctttcaatgacttgttcatcttccaactggcaaaattgctctctgatggatttatccttgctgttgtttagattcacttcgatccccccgaccgcacctagatagaaatattatacattaatggttgaaatatcgtcaagctattctagattcccacgccgccatttttcaaacgttttcaatacatcttctgacaattcaatcttggatgctggtttatcagaagtaatctttttgactctcgtttcaatctttcgttcgatcacttcaatctctcttaaaagctctcgagccgacttccgaagagctccttgtccaaagattgcccattgttctgtaaagtctgaggtcgccacatgaatctgcgtccgaatattattcaaatcctgggcaagcttttcaatccgctcatcagctgtttcattctctctcgtaaagatgacctctacccggtgattgatccgctttttttcgattcctttgaccatatgggcatcgaatacgacaatgactcgataccctgtgtatgcttgatattctgctaaattttgaatcagtatgtctctggcttcttcaaagctgttttcctttaagtgctgcagccgcggccatgcacctatcatgttgtatccatcgactaagaggatgtccatctctattctcctaacggataacgttttcgatacacttcatacatcaatagactagcagcaactgacgcgtttaacgaagtgacctttccggccataggcagcttaatcagaaaatcacacttttctttgatcaatcggccaatccctttcccttcactgccaatcacgagagcaagcggcatcgtgccatcaaattgtctgtaatcctgtttggcagacgcatctgttcccgcgacccagattcctctttctttcatctcatcaagagctcttgaaagattggtaactttggcaacaggaatatgttcaattgctccagtggatgctttggcaacggttgtcgttaagccgaccgctctccttttcggaatgacaatcccatgtgcacctacagcatctgctgtacgcataatggaacctaaattatgagggtcttcaatttcatctaagataagaaaaaacggctgttcattccgctgttcagcgatttgatatagatcgtccaattctgcatattcatatgctgctacttgtgcaacgattccctggtgctgacctgttaccatttgatcaagctttttcctcggaacatactgaatggtgatattttgtttttttgcgagttcaatgacctgctgggcttgtccttttacagtgttttctgccatccagagcttgtataactcccgatctgacttcagtgtttcaatcactgcatttttcccaatcacataatcatgttgctgactcatttgtcttcctccctgacgttccgatttcaatcgcctgactaatcagctcttctaagcgttcgtcctgcttttcaataaataaataacccatgagcgcttcaaacgccgtactataacgatacgtttgaacgtctgtgtttttaggcactgtgcctgattttgcatttcttcctcttttcaacaccgcttcttctgcttcagtgaaaaagccttgctgctgaagcgtaaataaaatagctgcctgagatttagctgaaacaattttgcttgctcgtttgtgcagctcatttggttttgtcgcccccgtttggaggaggtgatgcctcacgtagacttcaaaaatggcatcacccatataagcaagcgcaagtccgttcaattgtttaccgtctttcagcttttcaaaattcaacatgacctattctcctcttttccagcgagtaccttgaggagtatcctccaatacaatattcatgctctttaactggtcacgaatttgatcagatagcgcaaaatcacgatttcttctagcctcattgcgtttttcaattaacgcttctacttcttcgtcaagcgtatgcttttcttctaatgagaagccaaggacagaggtgatttcttggaacaagccgataaatgccttgatcacttcctccgaagtatgatcattttccatataataattcgcctgtttcgcaagttcgaataaaacagagatcgcatttgccgtattgaagtcatcattcatttcagaaataaacgtcgctcgctgctcttcaaccttcgccagccattcagcattatcttctgtgatattcgtgctgctttcaaggcgatgatgtaaattagcatacgacgttttgagccggttaaacgcactctttgtactctctagtaagtccattgagtagttaattggatgacggtagtgaaccgacaacataaagaatcgaagtacgtcaggatcttgttctttcacaatgtcatgcacgagcacaaagttgcctagtgattttgacattttttcattctcaatattaatatatccgttatgcatccaatactttgcaaaaggtttgcctgtcaaagcctcagattgagcgatttcattttcatggtgagggaaggttaaatcctgtccgcctgcatgaatatcgatcgtatcacctaaatattttttaaccatggctgagcattcgatatgccagcctgggcgtccttcgccccacgggctatcccatgagatttcttggtcctttgcagccttccataaagcaaagtccagcgcatctcgtttcttctcacctacacgaatacgggcacctgtctttagttcatcaatcgactggtgagaaagctttccgtagccttcaaatgagcgtgtgctgtaatacacgtcaccatctgcttcataggcgtagcccttctcaatcaatgtcgcaataaatgcaatgatatcatccatattttccgtcactcgcgggtgaaggtcagcttttttgcagcctagtgcactgacgtcttcaaagtaggcttggataaaacggtcagcaatcgtcggaacatcttctccgagttcattggctgctttgatgagtttatcatccacatctgtaaaatttgagacaaagttcacatcatagccactgtattctaaatacttacgtacagtgtcataaacaatagcaggtcttgcattcccaatatggatgtagttataaacggttggtccgcacacatacatcttgacctttcctggttcaagcgggacgaattcttctttcttacgtgtcaatgtattataaatattgattgtcatgattgttcttcctttctgctcaatgaagccagctcaccttttagcttttccatttctcgttccaattctttgaaacgatcggaaattggatctggcaaatcttgatgattgagatcacgattaattttcttaccattttgaacgacgactcgcccaggtataccgacaacggtggaatggtctggtacgtcctttaacacgaccgaccccgctccaatcttggctccttttccgacagtaatggaaccgagcacttttgcacctgtcgcaatgagtgcatcgtctaaaatggtcgggtgccgctttcccttttctttccctgttccccctaatgtcacgccttggaaaacagtgacgttgtctccaatttcacatgtttccccaatcaccactcccataccgtggtcaatgaagaagcgcctgccgatggttgccgcagggtgaatttccacccctgtgaaaaaccggctgacctgagaaatgatccgagcaagaaagtacagcttccgcttataaaatgcatgcgcgatacgatgagcccaaatcgcatgaagccctgaataggttagcactacttcaatatagcttctagcagcaggatcttgatcaaacacagtatcaatgtcttctttcagcattttgaaaaacacatgcttccccccgttcttccccatcaatctctcttcggacttgctctcttttttggacaaataaaaaacgcctctgccatatgacagagacgttttgaaaacgcggttccactctgtttagaaagccctcatttcgcagccttctcaacttaatcccataacggagggtaccgcccttgcatactaacgtactcgtgttcctcaagggtcttgagggtgcatttccaacgtctgcccataagtctctttcagccggtggagactctttctgtgatgggcgaaaacattgtacttctccctcgcaacgatttccttatatttgtttaatgcggtttaataccgtttcttttcctagtagttcaatactttgcggaagttctgggccatgcgtttgtcctgtgacagccacacgaattggcatgaagagtttcttgcctttatgccctgtttctttttgtaccgctttaatagcagccttgatttcatcaggtgtgaaagattcaagtcgttcaagctgaccagcaaaagacgccatgacttctggtacttgctcctctgctagaacttccttcgcctcttgattatactcaatttgctccttaaagaacaactctgttaactcaacaatttctgctccatagctcaattgttcgtgatacagagcaatcagcttgcgcacccacgtgttttcttcatctgacagctgctcacttactttgcctgccttttgaagatgtggaagtgttaacgcaacaacctgatcaagatcaagtgctttcacgtattggttatttacccattttagtttatgcatatcgaatagagctggtgacttagaaagtcgatttacatcgaaaatgtcgatgaattgctcttttgtaaacagttcttcttcgcccactggagaccatccaagtagtgcaatgaagttgaacagggcttctggtaaatagcctaagtttttatattgctcgatgaattgaataatggattcatcacgcttgcttaatttcttgcggttctcgttcacaatcagcgtcatatgtccgaatagcggaacatcccagccgaatgcgttgaagatcatgatttgtttaggcgtattcgaaatgtgatcctctccgcggagaatgtgagtcattttcatcaaatgatcatctactgctacagcgaagttataagtcggcgtaccatctttcttcacaatgacaaagtcaccgatgccgtctgtctcaaatgaaatatcgcctttgaccatgtcgtcaaatttgatgatttctccttttggcactcggaagcggatgcttggctctcttccttcagcaattagcttgtcctcttcttcttttgataaatgactgcatttaccagaatatcgaggcatttcactgcgggcgatttgtgcttcacgctcttcctctagctcttcagccgtacaatagcacttatacgccaagtccttctctagcagctcatcataatactttttataaatatcattacgctctgattgtctgtaaggaccgtagccgccatctttatcaatgctctcatcccaatcaataccgagccattgcaggtggcgcagctggctttcttctccgccctctacattacgcttttggtccgtatcttcgattcgaataataaatttgccgccttgactgcgtgcgaacaaatagttgaaaagagccgttctagcattcccaatatgtaaatgaccagttggactcggtgcataacgaacacgcacttcatttcccatgagtttaacttcctttcatctgcatcatgttgtctgacaccaattttttataaacgtattttatcatcaaatcacattctcatcaaaatgagttttactttttctgaagaagcaccgttgcttgagaggcaattccttcgcctcttcctgtaaatccgagtttctccgtcgttgttgctttcacattcacctgtgtgacctctgcctcaagcgcttctgcaatcttctcacacatcggttgaatgtaaggtgccattttgggcttttgcgccataatggtgcaatcaatattcacaagtgtgtagcctttttcctttactagtgcccacacatgctgcagtaatttaaaagaatccgcatccttaaactcaggatctgtgtctgggaaatgtctgccgatatctccttcagcaatcgcacctaggcaggcatctgccactgtgtgaagcagtacatcagcgtctgaatgcccaagcagccccttttcataagggatggtaaccccgccgataatcaaaggtcttccctcagttaattgatgtacatcaaagccttgtcctattctcaacatgatctagtaccctctttccgcatccataattgccttggcaaccaataaatcatccggtgtcgtcagcttaatattggtgtaatctccttggacaatatacacgtcttcaccatgtaattgttccacaagactggcgtcgtctgttccaaggaaaccggtccgctctgcatattcatgcgcctcttttaaaatagaatgacgaaaagcttgtggggtctggactgcccacaagctctgacgttcaatggtttgttccactttgccttcttgaacgcgtttgattgtgtctttcactggtaccgctacaactgcggagcctttttcaatcgctgctttaacgagcaagtcaatctgtgtatgcttaataaaaggccttgctccatcatgaacaagcacgatgtctgcatctttcacagcctttaatccttcgtatacactttgctgacgttcttcgccgccggtaacaagtgaaacaggcgtttgaaaagcgtgtaccttgagtagcctttcaaagtcttgacgctcctcttcattgatcgctaggatcatgcgtttgcattgagcatgagcgtcaaacacctttagtgtatgaataatgaccggcattctttttagctcaataaaaagcttattgcggccggccttcattcgtttcccctgccccgcagccggaataactacttcataatacatgttcgttctccctttagagcgccttctccagaagttttggcttcgcaaaaatcattcttccagcagcagtctgcagcacacttgtgacgagcacatcgatgtcttttccaatgtaattgcgtccttcttcgaccacaatcatcgtaccgtcatctaagtaagcaacaccttggttatgctctttcccatctttaatgacctgtaccttcatttcttccccaggcagcactaccggtttcaccgcattggctagatcattgatgtttaacactgctactttttgaagttcgcatactttatttaaattaaaatcatttgtcacaacaacacctgaagttaatttagcgagcttcacaagcttgctatcaacctcttgaatgtcttcaaagtcaccttcgtaaatttcaactttgatatctaattctttttgaatacgatttaaaatatcaagacctcttcggcctctatttctctttaatacatcagaagagtctgcaatatgctgtaattcctctagcacaaattgaggaatgaccatgatgccttctaagaatccagtttgacaaatatctgcgattcttccatcaatgataacacttgtgtctaaaattttcagctttttatcttctatttcaggttcatcatcagctgctccttttttcttggtgacctttgcagatcgggagaacagccccatcatttcatccttcttcttaaagcctacctgaaatccaaggtatcctaaaaagaaagccaggaaaatcggaataatggtaccaaaaatatgatatgggatattgtttagcgggatcacgtttacaataagatatgctagaataagtccaaatactaatccgaaacttccagaaataagatcaggaagaggcgcctttaagagagaatcctcgatccatttcacccaattaaccacataacctgtgcaccatttgccgatgataaagaacacagcggctcctattagtgctgaagagtaagcatttgttatgaaaggtatgtcctttacatttaacagcagaaataactctggaatgataaaaatccctacaactgcaccaaaaatgataaaaaacgcctgaacgattctttttaacataccttcacctcctttatttttcatctgtcaatccaccctcacctgacattgatatatgtttaagtttcctatcataatcaatagaaaacaaaagcatcattaatatacccatattcatccatttttaaccgtatttaaagaaaatttctcttcttacagctgtcggtcgatataatgtttttcttgcagcctttttaatcctttttttatctttttcgctcttacttctccaattccttctacttcatccaaatcttgtacatctgcttccataattcgatctaacacaccgaacgcttcaaccacgttttcgacgattggcataggcagtctagggattttgtgaagcagtctgtaacctcttgtgtacacatattcgtcaatatttgtagaagctggatagccaagtaacttgtacagaatggaatcatctaaaagctcaaagctagacatatcttggagctgtttaagcagaacatatggatctttaatcttttctttcacgtaatctttaataaataaagccgcttcctgctccatatctgtaatcagttcattgacttgcagacgaatcaaatgtccttctgttccaagctctttaatatacatattgatttcatttttgattctaagcaccatttcgtaacgatgcaggacggataatacatcaccaaaggtcacaagctcttcaaattccagggcgcttaacgcagaaatggcatgatctaaaatggttttatatttctcaagtgtttgtatggcttgattggccttcgttaaaataaagccaatatctttcagcgtataacgacgattcccttggtataaggtaatgacgttcctccgttcagaaatcgcaatgattaaacagcctgtctgcttcgctacacgttcagcagtacggtgcctcatgcccgtttccgatgaatgaatggttgcatctggcatgagctgtgtattcgcatacaagatcttttgaccagaatcgcttaaaataatggctccatccatcttcgccaattcatataagtgtgctggggagaaggcagaattaatatgaaatcctccatcgacaacactttttaccttgtcgttataaccaacaacaataagcccgccagtattggccctcaggacgttttcgatcccagcccgaagaggtgtccctggtgccacaaactgtacaatatctaagagatcgagttctctcgctccttttttctctttttccatttctatgatccccctagtgaaattcgaagtgcctccgctacattttcaacaccgactaactcaatccctctcggctttttccatccatctatattcgcttgaggaataaacattcgcttaaatcctagtttcgcagcttcctgcacacgctgttcaattcttgatactcttctgacttctcccgtcagaccgacctctcctataaagcaatccgcttgatgcggcgctgcgtctttaaagcttgatgcaatactgaccgcaatggccaagtcaattgctggttcgtcaagcttcacaccgcctgcgacctttaaatacgcatcctggttttgcagcagcagtccaacacgtttttctaaaaccgccatgagcagtgacactcgattatgatcaagaccagtggccattctacgcggatttccgaagcttgttggtgaaattaacgcttgtatctcgacaagaacaggtcttgttccttccattgaggcaacaacacacgaaccagatacacctgccgaacgttcttctaagaaaatttcggatgggtttaatacttccgtgagcccttcctctctcatttcaaaaatccctagttcattcgttgaaccaaatcggtttttcactgcacgtaagatacgaaacgtatgatgacgctcaccttcaaaataaagaaccgtgtccaccatatgctctaaaagacgtggacctgcgatcgagccttctttggtcacgtgaccaacaataaaaattggaatcccatttgtcttggcaatcttcatcagctgcgctgtacattctctcacttgagatacagacccaggggctgacgtaatatcgctttgataaacagtttgaatcgaatccaccacgacaaaagcgggtttcatctcttgtatagcagacgttatatactccatatcggtttcagccaaaacatgtaaagaggtgctttttatgccgaggcggtccgctcttaacttcgtttgtttaatggactcctcaccggatatgtataatacattctgatttttgtctgagagctgtgctgatacttgtaataataatgtggacttgccgatcccaggatctccgccaataagaacaagagagcctttgacaattccacttcctaatactcggttaaattcttctaaattcgttttgattcggggttcatctgatgtttcaattgcagaaataggtgaaggtttttgaatggtttggacagaatgattaaaagcgcttcgacggtttaccggctctttacgaacgacctcttctgtcatactgttccacgtgccgcagcctggacatttccccatccatttggctgattcataaccgcacgattggcatataaattttgattttgtcttagccatagattgaagaatacaactccttatactggtcagaaaataagtaaagggaggcatacaccttactggtatgcctcacacttttttcttactatattagttcgtagcagccgtcgtttttacgacaatttctccatcttccacatctaatacgatttgttgacctttttcaatattaccctttagaagctcctcagaaagtcgatcctccacatgcttttgaatcgctcttcttaacggacgcgcaccgtactcaaggtctacaccttcgtcggcaatcttcgcttttgctgcttctgtcaattcaattgaaaggtcttgttcttttaatcgtttcgtcaattgatcagacatgagagacacgatctcttttaaatgtttcttttcaagtgaatggaagacaatgatttcatcaatacggttgatgaattctggtctaaacgcacgtttcaactcgcccatcactttgcccttcatatctttgtaattttgaccttcatcctgcacgttaaagccaacatatttatttcgcttcagttcactagctccaacgttggatgtcatgatcaaaatcgtatttctaaagtcaacggtacgccctttagaatccgtcagacgaccatcttctaatacttgcagtaagatgttgaatacatctggatgcgccttttcaatctcgtctaaaagcacaacagaataaggttttcttctcactttttcagtcagttgtccgccttcttcatagccaacatagcctggaggtgacccaacaagtctagatgtagaatgtttctccatgtattcagacatatcgatacggatcatcgcttcttcatcaccaaaaatagactctgcaagtgctcttgcaagctccgttttaccaacccctgttgggcctaagaagataaaggagccaattggacgttttggatcttttagaccagcacgcgcacgtctcacagcttttgctacagcgacaaccgcttcatcctgcccgattacacgagaatggagtaattgttccatattcagaagcttatctgtttctgtttgggcaatttttgaaacaggcactcccgtccagctagagacaaccattgcgatatcatccactgatacctctgaattctcctgaccttgcttttctttccaagatttctttgtgacttctactttttcacgtaaacgctgctctgtatcgcgaagagaagctgctttttcaaattcctgactttgaacagccgcatccttttccttgcgtacttcatccaatttttgctctagttcttttaggttaggcggtgttgtgaaagaacgtaagcggactttcgaacctgcctcatcaattaaatcaatcgccttatctggaaggaaacgatcagaaatataacggtcagacagcttcaccgccgcctcaatcgcttcatctgtgatggacacacggtgatgtgcctcataacgatctctaagacctcttaagatttgaatactttcatcaacggatggctgatctacttgaattggctggaaacgtcgttcaagcgcagcatccttttcaatatatttacggtactcatctaacgttgttgccccgatacattgaagctctccacgtgctaaggatggtttgagaatattagatgcgtcaatcgcaccttctgctccgccagcaccaatcagtgtatgaagctcatcaatgaagagaatgatatttcctgcctgacgaatttcgtccatgacttttttcaaacgatcctcaaattcaccacgatatttcgttcctgctacaacggttcccatatcaagcgtcatcactcgtttatcccgcagaatttcaggcacttcattatgaataatttgctgtgcaagaccttcagcgatggctgttttaccaacaccgggctcaccaatcagcacagggttgttttttgttcttctgcttaggacctcaatgacacgctgaatttctttgcttcgtccaatgacagggtccaagctgtcttctttcgcaatcgctgttaaatctcttgccaagctatctaatgttggtgtatttgcattgctgttagagccagcggcagatgcacctgtttcattgctgccaagcagctgcaggacttgctgacgtgctttatttaagctcactccgaggttatttaaaacgcgggcagctacaccctctccctcgcgaataagacctaatagaatatgttctgtccctacataggaatgacctagctttcttgcttcatccattgaaagctcagtgaccttcttcgctctaggcgtataatgaggaatagcttgagacacctcttgccctcttccaatcaagctttcgacttctttttggattttatctgaaacaaggcccagtgcttctaacgcttttgcggcaataccctcaccctcgcgtacaagaccaagtaaaatgtgttcagtaccaatgttcttatggcctaggcgaatggcttcttcttgtgcaagtgctaataccttttgagctctttcagtgaatcttccaaacatcatatcgtttcatcctcctgtccattcctatgcatttctaaacgcagcctttctctaataatcgctgctcgttttatatctcgttcatttggctccaaagctcctccagaatattgttgaagaaagccaggctgtgtcaaaatcatgagttcattcagtatattacttgaaagccccttaatgatacctaaatcaattccaaggcgcacatctgacaaacacttagctgtttcctttgattcaatcatccgacaattggacaaaatccccaaggaacggtacactctgtcctcaagttcaattttagatgtttgatataacgcttttcgtgcagatcgctcttgttcaatgagctgagcggtcacactatttaaatcatctacaatatcctcttctgattgaccaagtgtcatttgatttgaaatttgaaagatgttccctattgcttcgctgccttcaccataaattcctctgactacaagacctaattgattaatcgccggaataatccgattcatttgtcttgtgagggctaaagcgggtaaatgcatcatgaccgaagccctaatacctgtacctacattggttggacagcttgttaagtatcctcgcttttcagaaaacgcataatccacttgctcttcaatccagtcatctatctggttagccgcttttaatgcattggctagttggaagcctgggaataagcattggattcgaatatggtcttcttcattcagcatcacactgatttcctcattttcagaaagcaaacaaccgccaaatcttgattctgctaagtttgggctgatcaaatgcttttcaacaagtactctctttgctaaaggctgcgtttcattcattcgaattagaacaaagtttccaatgtccttcacttcctggctagcaaacttttgctcgaattgctggagaacagcttcagcctcttcctgagaaaactgagttgggaaacgaacatgctctaagtttcgtgctagcctgattcgactgcttagaacaatgtcactttctggtcctttttgtttcatccattgacttaaagcgtcttgaataaaatgctggagcgacatgttgttaatctccctccctctgctgagattgctcatgctctaatgcacgaatttgatctcgaacttccgctgctttttcgaactcttcttgttcaattaactgcttcagctcttgctgcatcaactcaagtttccggcgcacatgaagactgccggcaatccgtttagggacttttccattatggactgtatttccactatggactttccgtaaaacagggttcaaatactgatcaaatgaacgatagcattctgcacagccaaaacggcctgtttttctgaattgttgaaaggttaagccacacttaggacattgatccacttctctcgcttcttgaaaaatagatgatcccttattcgcacttgtggtaaagctaggatcaatattcaataaacccgataataagttgtgaatcgagaaaccttggttcccactcatagcatatgaatcactgttttcttttgcacattgttcacatatgtgcatttcttgtttttctccatttataactttcgtaaagtgaaaagtggctggtctctcattgcattcttgacaaatcaatcttttcacccgctttactttaatttcaaagcatttaacatcgctttcatcatccgagcccgcaattcatctcgttcaggtaaatcaatgtgcaaaacagaacggtccatgacactgatcatcatctttgcttctctttcagataaaatgttattttcgacaagacgcatgatgatatgatcagaggcagcctgtgataaacgatgatatatttgggaaataatattgttcaataagtcgacttcatcattcattttgactttaatgatgcggatatagccaccgccgccacgcttactttcaacgatgtagcctctctcgctcgtaaagcgtgtattgataacatagttaatttgtgaaggtacgcattgaaacttatctgcaatttcattgcgcttaatttctaatatttctcgaccattctgatccaagacttctttcaagtactgctcgatgatatcagaaatattttgtgccactccgcctcctcctccattgactttgactatatttgactttaatcttactataaattttttcggtcgatttttcaagataatcgctcaactaagaatattatttccacatttatatggtgtcaaacctcctaaggatcagttccattaggaactggtcttttttgttttttaagaaaaggaacaaacacccgatctgacatggatacatatactaaactaccatctaaaacattcttaattttgtatacaattgaaagcgctagggcatactgaagctataagtggaggtgtcacaatggacaaaaaagagcgagaagcgatttgtttgatttgtgaagagaacaagacaaagggaatttatttatatcatcagtttttgtgccgagactgtgagcgaaagttaatttctacatcgacctcggatcctagctattcagattatgtgagaaagctcaaaaatcttcatacgccgcctttgtattcatagaccactagatggtctttttttatgagctatgaaggattgggcttgttttttggaacttagtttggacatcatccgtaattcataataagataaacagagagcctgattattcataggagtcgataaacatgaaatcaatcttttatacatttatatgggccatcctctctacttttttttcgcttgtgattttaaccgtcagtataggggttttccatcatcatgctggattatcgatactgtatgcgatgattgggtggggtgtgatgtttgtagggagcagatggactgctttccaattgtttttaaagaaacacggactgtctcgtagtgattatgtatatatcaaacagcatttaaaagaagcagggcaaaagcttgtgcgtttaaaaaaagctttatttgctgtgaaaaacgtacaaacaatcaaacataattatgaagtttttcggcttgcacgacgaatctatacaataacaaaaaaagagcctaatcgattttatgatgcacagcgtttttattttgaaagcttggattctgtcgttgaactaactgagaaatatgcactcttatataatcaacctaatcgtagtcatgagctggaaatgacattgagccaaacccgagtgacattgacagagctgcaaaagcaattgacgaatgatttgcagcaagtgttaggaagagatatagaagctcttcatattgagcttgaagtagctgataaaatgatgaagaaatagatgaaaggagtcaacactcgatgaaaccggaagatcacgccataacaccgcctacctccaatacagatcttcagtttcgggtgtttgataccttatctgatgaagaaaaaaaagaagccgtgcagcgagctcagcagatccctgacaatccgcaaaagctccttttctatggtacacgtgtgcaggaacgactattggaacaatcacaacagatgatgaaatatgttgagaaaaaagatatcgatcaaataggagatgtgctggaggcctttttgcagcagttgcatgtagtggagcctgaggatttagtgccaaagaaacagagcatttttttgaaatggtttcaacgagataagcgatctactcaggagatcatatcacgttttcaacatgcaaaatcacagatcgagagattgtcagcaaggcttcgttatgcaagaggcgtattaatctcggaccatatgttattagagcgtttatttgaagaaaatcaaacttattttcaagagatgacgatgcaggttgccgcggttgaagcgaaaatgtcaacgatagagcagcagtctctttcagaaacgcaactttctgttgaacggacaatagaggagcaattgatgagtcaagaagtcaatgaagaagagtatgtggagagactaaaggaacgaaagtatgatttgctgttaagccggcaaattgcattgcaatgtaatgctcaaattcggatgatccagcatacgaatcatacattggccaatcacattcaatcaactgtttcagcatctattcctctatggatcaaccaaatgtcgattgcattaacgcatattcagcagcgggccaattcagctcttgagaaccgaatcgaaaaaacatatgaaaatgtatcgaaacagcaggggcagattcttgaagaggcatctttagctcctatagatacgttgaaaaaggttcaacgtcaattagctgaaacattacaggaaacgttacaggtgaaagaacatggaagccaagagcgggctcaattgaaaagcagtatgtatgaggcagagcagcagttggcgaatccaataaaggaatgagaaaccatctttcggttcacttgtttgaacgttataatagaattaagatatcgttaaagtgaaaagggtcgatttgtttgagaacacctttatatacagcattagcacagcatgcggaaaagaaaccttattcttttcacgttccaggacatcacaatggagatgtcttttttgatgaggcacggtctcactatgcttccatccttcaactggatgtgacggagcttgaaggtcttgatgatcttcatcatccgactggggtcatccaagaggcagaacatttattgactaagctatatggttcagatcaaagcttcttccttgtgaatggcacaacagtcggaaatttggcgatggtgatgacagcatgccgcacgggagacgagatttttgtccagcgtaattgccataagtctgtcttccatgcgatcgagctggcaggggcaacgcctattttgatagacgctgagatagacgcacacttgcacgttccaacacatgtgacggatgatacagtgagaaaagccatagcaagacatcctcattgccgggtaatcgttttgacttatccgaattactacggacatgcagctgatttatcaaagctaattcacatgtgtcatgaagcaggtatggttgttttggttgatgaggcacatggtgcgcattttgtattaggcggcggctttcctccatcggctctttcctatggagcggacgtggtggtacaatcagcacataaaacccttccggcaatgacgatgggttcctatcttcatcttcaaggggatcgaatcgatgcgaagcgtttgaaaaccttgctgacgatgcttcaaagtagttcgccctcttatccaattatggcctcattagatgtggcaagagcttatgccgaggagatcaaaggaaaagggacattgggtgtaatcatgaaagaactgacagagttgaaagatcagttcaaccttctgaatcaccttgaagtggttgagcctgaatcgttgccctccgatcctttaaaatgcgtcattcgatcaacaaaaggactgacaggttacgaactaaagcaggtgcttgaatcagtggatgttcatccagagcttgcggacgaacatcaagttttacttgtacttagcttagaacagaggaaaaacgttcctttcaagcggatcgagcaggctcttaagcaaagtaattcattgctcaaagggaaaaaacatatccaaaatgaaacggtatctattgagactgatatactaaatcaagacatagaggctgtcccatttgaacaagcagcagaccgggtgagtgcagaatccattattccctatccacctggtattcctttgatgattaagggagagcgcattgaaatagaacaaattgaggcgttaagccgtttgcttggtcacgaggttcatattcaagcaagtcaggtcattcatcagagaaaattatatgtttatatagaagaggagacactatgagcggtatgtttattacgtttgaagggccagagggcgccggaaaaacgacagtgatacgaaaagtgtacgaagaaatggaacgtcaaggatatgcagtgatggcgacacgcgagccgggcggcattgacattgctgagcagatccgtgaagttattttaaatgaaaaaaatacaaaaatggatgcgaaaacagaggcattgctgtatgcagcagcaagaaggcagcatttggctgaaaaggtagaaccggcattgcagcgcggagagactgtcttatgtgatcgttttgttgatagctctcttgcttatcaaggctatgcgagaggacttggaattgaccaagtcagatcaattaacgactttgctattgatggcacgatgccgcaaatgacaatttacttttccattacacctgaggaagggctaaagcgaattcacgccaatctaggaagagaaaagaaccgattagacatggagacgctgaatttccaccagttggttagagaaggctatgaactgcttattgcgcaatcaccagaacgattccgcgttgtggatgcttctcagccgatgcaggatgtctatgaagaagtacttcgagtgattcaggacacattaaagaaaaatcaaatatgacctcattcccaatcgttgttataatatagaggaagacatcggcatgtcacctgtgcctaaaacaaaggaggccaatcaaatgaaattaattgttgccgttgtacaggaccaagatagcagcaagttgttgaaaatattgactgaacatcaattcggcgtgacaaaattagcttcaactggtgggtttttaaagtctggaaacacgacttttatcattggttgtgatgatgtccgagtggataaagcgttacagcttataaaagaaaattgccgtaaacgtgatcaaatgattgcacctgtatctccaatgggtggtaacgcagattcatatgtaccataccctgttgaggttgaagttggtggagctactgtctttattctgccagttgaacaatttcatcaattctaaggatgggttgctgtgaaaattaatcaagatatgcggctgcttttagaaaagcgtgaactccaaggcattaaaggaagccaaacatctgcctcctttaaagcatcgatggagacgcaaagcggcaaaatgcgcttagagcagctgacggttatgctaagtgatatcgaagtgttcggtaaaaagctgacaaagtcacgaaacttaaaggacttggctaggtttaaaggtcttgtgaagcgctttgtgaaagagacagtcgataatggattaaatatagaaacatcaagaagctttgacatttatggcaacacgcgtacactcgctttagtcaaagcattagatgaaaagctgattgaattaacagaggatatgatggaccaagagaagccatctattgatttgcttgaacgtattggagaaataaaaggtttattgattaacctttacacatagagagtgataacatggcaattagctgggatgacatgaatgatttgcagccgcgcgtcatgcggctgatttttaatagtattgataaagaccgacttgcgcatgcttacttatttgaaggaaaaaaagggaccggtaagcaggatgctgcgatgcttttggcaaagagctttttttgcttgaaatcaggagtgaaaccgtgtgaatcctgtcaaaactgcaagaggattgaatcaggaaaccatcccgatttacatctcgtgcagcctgatggtcaatcaattaagaaagctcaagtacaggcattgcaagaggaatttacaaaagcaggtgtggaatctcaccgaaaaatgtatatcattcttcatgcggacaaaatgacggtcaatgccgcgaacagtttattgaagttcctagaggagcctaaccgggaaacgatggcaattttaatcacggagcaatcgcataaaatgctggatacgattatttcaagatgtcagatgctcagctttcagccgctgcaaccacaatccttggagcagcagctattacaagaaggcgtatctcagcatcttgcaaggcttttgtcgaatttaaccaacaatttagcagaagcactcgaattaagtcgaaatgatcagtttgcagagtctagagcgaaagtgataaaattgtatgaagtcttacaccagcgaaaagaacatgcatttttttatatacaggatcaatggatgccttttttcaaagagaaagaccttcaagaaacaggtctggatatgcttttatttatatatcgtgatgtattgtcgattcaaataggaaatgaagataaagtcatttatcaagacttattccagacaatgaagcagcacgcgctgcattccacacagcagatggtgacgaaccagatccttgctgtattagaagcgaaaaaaagacttcaatccaacgtgaatgcccaagggctgatggagcaattggtgttgatgttgcaggagggataagcttgtacaacgtaattggtgttcgctttaaaaaagcgggcaaaatctattatttcgatcctaatggatttcatatagaaaatgatagttgtgtcattgtagagacggtcagaggagttgagtacggacaagtggtcatcgctaataaaaaagtagatgaacacgatgtcgttcttcctctgcgtaaggtaattcgtgtagcagacgaacgagaccggctcatcgttgaggaaaacaaagaagcagcgatgacagcctttgatacatgtcttcagaaggtaagtgaacacggtcttgaaatgaagctggttgatgttgaatttacttttgaccgaaataaggtcattttctacttcacagcggatggaagagtagatttccgtgagctagtgaaggatcttgcatcgatcttcaaaacgagaattgaacttcgccagattggtgtaagagacgaggctaaaatgctgggtggcataggaccttgcgggagaatgctttgctgttcgacattcttaggagactttgaaccagtatccattaagatggcaaaagatcaaaacttgtcgctaaatcccacaaagatttcagggctttgcggtcgtttgatgtgctgcttgaaatatgagaatgatgagtatgaaacagcgaaagaacaattgccggatatcggtgaaacgattcagacatctagtggctctgcaaaggtagtagggctcaacattttagaacgaattttgcaagttgaattaaccgggcaagaaaaagtggtagaatatacttgggaagaattattacaagaaggcgttgtatctgcacaaacaactgagtaacgaggtgtgccaccttggataaaaaggaactatttgatacggtgatcaatttagaagaacaaatcggttctctttatcgccagttaggtgatttgaaaaatcatatcggtgaagtgattgaagaaaatcatcagcttcagatggagaatcagcacttgcgtgaacgtctggatcagtccgatcgggacaaatcgtctgagacagagaatgattctgctcagaaaccaggtcattctgatataggagaaggtcatgataacctggctcggttatatcaggagggcttccatatttgcaatgtacattatgggagcatacgtaaagagggagactgtttgttctgtctgtcatttttaaataaaaaatgagaaaaggcttccgctgaatcggaagcctttttcacaggaaaagaaaggatacatcatggtttcgttaagagaagatgaacgattagattatttgctcgccgaagatatgaaaattattcaaagtaaaacggttttcgccttttcattggacgcagtgttattagcaaaatttgcgtatgtgcccatccaaaaaggagagatcattgatctttgcacgggaaatggtattgtgccattgctgctttcgactcgatctaaggcctccattactggggtcgaaattcaagaacggttgtttgatatggcaaaaagaagtgtggcgtataatcaatttgaaaagcagatagaactgattcatggtgatctaaatgatatgccagcacgctacggcaatcacaaagtagatgtcatcacatgtaatccaccatattttaagacaccttctaaagaagaaatcaatgagaatgaatacttggccattgctcggcatgaaatccattgtacattagaagatgtcattcgtgtttcttccacgctgctgaagcaaggagggaaactggcgatggttcatcggccgggacgactgcttgagattgtggaattgatgaagaagtaccgaattgagccaaaacgaattcaatttgtttatcccaaacaggggaaagaagccaataccatcttagtagaggggataaaagatggaaaaccagatctgaaaattctcccgcctctttttgtttatggagatgatcaagagtatactgaggaaatcaggacgatactgtatggagaagcataatcattatttctatgtattgaaatgtgcagatggcagcctatatgcaggttatacaaatgatttacaaaaaagactgacgacccacaatagtggaaagggagcaaagtatacaagagcaagacggccagttgagctgtattatcatgaatgttttgcaaccaaaagagaagccatgcagcaagaatatcgtttcaaaacgtggacacggaaaaagaaagatctttatatagaagaaatgcgtattgaaaaggaggcggcacatgaaaacacagaaaagctttgatgatcaatcagatatgggtattctatatctcgtcccaaccccaattggcaatttagaagatatgacgtttcgagccatacaaacattaaaagatgtagactatattgccgcagaggatacaagacaaacgaaaaaactctgccatgtttatgaaattgatacgccattaacgagttatcatgagcataacaaggacagcagcggtcacaagttgatcgaatggttaaaagaaggaaaaaacatcgcactcgtgagcgatgcaggtttaccgacaatttctgatccaggtgctgaagtggtccgagactttacgaatatcggcggttatgtcgttccattacctggagcaaatgctgcacttacagcactcattgcatcagggattacaccgcagccatttttcttttatggatttctcgaccgacaaaaaaaagaaaagaaaaaacagcttgaaactttgaagaagcgtcaagaaacaatcattttctatgaagcgccccatcggttaaaagaaacgctgactttgatgaaggaagtgtggggcaaccggaaaattgccattacgagagaactgacgaaaaaatttgaagagtttgttcgtggagatttagagtctgtgctgacatgggcggcagagaatcaaatccgaggtgaattctgtcttgtcgtacaagggaacgatcaagatgaagaagagctaaatgaagaagcctggtggaagcccttatcagaaaaagaacatgtgatccattacatagaagaaggattaacgtcgaaggaagccattaagcgtacagccgtcgaacgtggtgtaccaaaacgcaccatttacgatgcttatcatattgaacaataaagaaaggttcttgcaaacggtgcaagaaccttttttatatcaaacttatttttgtgattgaagttggttttggatttcgttaatgatttgctctgcaccttcacggctaagaactaatttaccattagcaagtttaaggttatcgtctgatacttcacctgtaacttggcaagtcatgtttggtttatatttttttaggataattttttcatcatcaacataaatttccaaagcgtctttttcagcgattcctagagtacggcgaagttcgattggaatcaccacacgtcctaattcgtcaactttacgtacaatacctgtagatttcatcttcattctcctcccaaagagttcttattcttaatataatattatcttcgtcattattcgacaaattccttacattcatagcataacaaggtttccataaatcgtcaatcattttgtttactattgtttgtaaaatatgactcttaaagtcaaaagaccttgaaactactgatttataaggattttgcggctcttttctatgaaaatataagaaatgacgagctcagattaacaagacttttgccctaaattagacaattgtaaatctggaaatagatttcttacgacaatattcgacaaaatgtcgacaggtttgtcgtttttttcgaaaaactcatctttttcgatcatttcatcttgttctatgtatatatgcttgatcttaaaggctaagatggtatcatagagaaagcacaagtgcaaaatttaattaatggatctaacacattttcatgtaatgataataaccgctctcgtccattgggcgggagtttttgacatttacacacacgcaggaggttccaacatgccggaaaagaaaaaaacgttctatctgacaacacctatttactatccgagcggaaaattacatattggacatgcttatacgacagtagcaggggatgctatggctcgttataaacgtcttcaaggctatgatgtgatgtatttaacgggtactgatgagcacggacaaaaaattcagcaaaaagctgaagaacaaaacatcacaccgatcgagtatttagatccggtcgtagcagacattcaatcactatggaagaaactcgacatttccaatgatgatttcatccgtacaacagaaaaaagacatacgaaaatcattgagcaagtatttcaaaagctgcttgatcaaggcgatatttatttagatcaatatgaaggctggtacagtattccggatgagacattctatacggaaacacagcttgtggatgttgagcggaatgaaaagggagaagtcactggcgggaaaagccctgacagcggacatcctgttgaattaattaaagaggaatcatatttcttccgtatgagtaagtatgcgaatcgtttactagactattacgaaaagaatccaacgttcattcagcctgaatcaagaaagaatgaaatgatcaataacttcattaaaccaggtttagaggatttggctgtatcaagaacaacctttgattggggaattaaagttccaaacaatccaaagcacgtcatttatgtatggattgatgcgttgttcaactatttaactgcgattggttacggaactgatcaggatgaaaaatataaaaaatattggcccgccaacgtgcatctcgtagggaaagaaattgttcgtttccatacgatttattggccaattatgctgatggcacttgatctgccgctgccgaaacaaattttcgcacacggctggctgttgatgaaagatggcaagatgtctaaatcaaaagggaacgtagtagatccggtcacattaattgatcgctacggtcttgatgcccttcgttattacctccttcgtgaagtaccatttggtgcggatggtgtgtttacaccagaaggattcgtggaacgtgtaaactatgatcttgccaatgatttaggtaacttgcttaaccgtacagttgcgatggtacaaaaatattttgacgggacattaagcagctataagggtccagttaatgagtttgatgaggagcttaaagcagtagctgagcaaacagtcaaagcctatgaagaagcaatggaaaaccttgaattctcggtggctctctcaaatgtttggacattaatcagcagaaccaataaatacattgatcagacagctccatgggtgctggcaaaggatgaaacaaaacgaaaagagctgcattctgttatgtatcatttagcagaatcattgcgcatcacagcagtgctcttaacgcctttcctaacgaaaacacctgagaaaatcttcttccagcttggcattgaagaagagaaacttaaaagctgggatagcattctatctttcggtgcgattcaacaagcgacggtacaaaaaggagagcctttgttcccgcgtttagaggttgaagaagaagtagcatatattaaagagaaaatgcagggaagtgcaccaaaggtagaagaagagaaagtagaaatagaagaaacagaattacctgagctgggagcagaaattgcatttgatgatttctcaaaagttgatcttcgagttgcacaggtgctggaagcagccccagtgaaaaaagcagatcgtctcctaaagttgcagcttgattttggatttgaaaagagacaaattgtttcagggatagccaagcattatcaacctgaggaattagtagggaagaagctcgtctgtgtagcgaatctcacaccagttaaactcagaggggaaatttcccagggaatgattttaactggagaaactggcgggaaattgcaggttcttgaagtggatcaatctctagcaaatggaacaaaaattttataaatcaacaaaggtgttccacgtgtaacatttcgtcgaacaccttttgttttttggaagaattgtcgaaaggagcaatcaacgatgttatttgatacacatgcccacttaaatgcggaacaatataatgaagacttagagcaggtaatcgaaagagcgaagagtgaaaaagtcgaaaaaatcgtggtggtagggtttgatcgcccgacaattacgagagcaatggaattaattgaagagtatgatttcatctatgcagccattggctggcacccagttgatgccattgatatgacagatgaggatttgctgtggatcaaagaattatctgaacatgaaaaagtcgttgcaattggagaaatgggtctggattactattgggacaagtcgcctaaagatgtgcaaaaagaagtctttagacgtcaaattgctcttgcgaaggaagtgaatcttccgatcattattcataatcgtgacgcaacggaagatgtcgtgacgatcttaaaggaagagggagcggctgaagttggtgggattatgcattgctttactggcagcctagaaatcgcaaaagcgtgtatggatatgaacttttatatttcattcggtggacccgtgacttttaaaaatgcaaaaaaaccgaaggaagttgttaaggacataccaagtgaccggcttttaattgaaacagactgcccatacttaacgccagcgccatttagagggaaacgtaacgagccgagttatgtgaaatatatcgcagaacagattgcggagttacgagaaataagctttgaagagcttgctgaattgaccacaaaaaatgcaaaaaaagttttcggtataaactgacagtatatgatgtcaatccttgtttaagcttgtccatttgtgaaacataacgaaaatgttctacacgtttaagcctcttcataggataagttgtcgataagtctttcttcccttccttccattaaactcccataataggagtacaatcgagcatttttgtacagtgggtggaagggttgacaggttttgagatactctatataatctctccgaggagaaggaggcgtttttcatcgtacaaaaaatgaaaaatctgttttctgtaaagctaggaaaaggcaaggttttattactagttgtttgcttgcttttagctggaactgggacggcttacggtgcgcatgagctcactaagcagtctattaccatttcaattaatggtaaagagaagacaattcgtacacatgaagagacagtagcacagctgctttcagaccttggaataaagaccaaggcggaggatcatatctctccaagtctaaatacaaagattgaagacaacatgaacattgtgtatgatgcggctataccggttcatctgaccctagatgggaaagagaaaacgatatggacaacagatcagacggttggagcattattgaagaatgagaagatagatattgggaagcacgatcaagtaactccaggaaagaatgacaagattaaaaaagatatggatcttgtggttgagcaggccttcgaggtcagcgtaaatgatggaggaaaagagaaaaaagtgtggaccacttcgactacggtcgctgactttttaaagcagcaagagctgaagctcaagaagcacgataagatcaaacctgcgttacatagtcatataactaaaaaaagcgcagatattcagatcactcgggtggaaaaagtcaccgatgtagtggaagagaaaattgcttttgataccaaacataaaaaggatcgttctcttgaaaaaggaaaagagaaggtgcttaaaaaaggtgaagaaggtaaattgaagaagcactatgccattgtgaaagaaaacggcaaagtggtgtctaaagaattaattaaagaagtgactgaaaaagatagcaaggatcgtttagtggccgttggtacacaagagtcccaaaaagagcctaaagcgacacctgccgtttcaagaagcaatgaatcgtcaggaaaagaattttatgtggcctcgacagcctatacagcgagctgtgctggatgtacgggcagaacgtcaacaggctataatttaaaatcaaatccaagtgcaaaggtcatagcagttgatccgagtgtcattccgctaggctctaaagtgtatgtggaaggctatggatatgccgttgcatcagacactggatctgctataaaagggaataaaattgatgtgttcgtcccgaataagtcggcagcttatcaatggggaaataaacgagtgaaaattagagtactcaaataaacacatcaaatcatttatatgaacagagggctttgcgcaccctctgtttttttggttataatagaagcactgttttctaattaattagacgcaaaaacaacatgaaaggtttcgttttttaaccaaaaaatgttttttgtttttgcaagtggaggaatacatgaaaatcaaagaaatcattgtggtggaaggtcgtgacgacactgcgagagtgaagatggcagttgatgcagatacgatcgaaacaaacggatcagccattggcgatacagttattcaacaagtacgtcttgctcaggagacgagaggggtcattatcttaactgatcctgatttccctggggagaagatccgtaaaaccatcgcagaagccgttcctggctgtaagcacgcatttttgccgaaacatcttgcgaaggcgaagcgggacaaaggaattggtgtcgagcatgcttccttggacagtattcgagaatgccttgcccatgtccatgaggaaatggaagtaacggaaagtgacattacattagatgacttatttgacgcaggccttatcggaggcgaatcatcgaaacgccgccgcgaacgactaggtgtgcttttaaatataggatataccaatgcgaagcagctgcataagcgccttcacatgttccaaataaccaaacatgattttattgcggccttaaagaccgtcatgcaggaggaagccgatgaataaagatatagcgacacccatcagaacgaaggaaatactgaagaaatacggtttctcctttaaaaagagcttggggcagaactttttaattgatacaaatatactcgatcgtattgtcgatcatgcagaggtgacggatgagaccggcgtgattgagatcgggcctggtatcggtgcattgaccgagcagctcgctaagcgtgcaaagaaagtcaccgcttttgaaatcgatcagcgtttattgcccattttaaatgatacactttctccatatgataatgttacgatcattcatcaagacgtattaaaggcagatgtgggaaaggtcatcgaggaaaattttgctgactgtaaagaagtgatggttgtcgccaacctaccatattacgtgacgacaccgattattatgaaactgcttgaagaaaaccttccattgaaagggattgtggtcatgcttcaaaaagaagttgcagatcgtatggccgctgtcccttcatcaaaggaatacaattcactttctattgcagttcaatactatacggaagcgaaaacagtgatggttgtgcctaaaacggttttcgttccacagccaaatgtcgattcggctgtgatcaagctgaccgttcgtgaaacgcctgccgtctcagtagaaaatgatgagtttttctttcagttgattcgtgcgagctttggtcagcgccgaaaaacattgatgaataatctcatgaacaacttacctgatggaaagcaacataaagcaattattgaagaagcacttcaaacagcagacattgatggaaagcgccgcggcgagtcattatccattgaggaatttgcccgtttgtcgaatgttttacaagaagctctgtcttaagagctttttttgtttttcaccacttcgcttgttcgggcataggctagaaagaacagcacatatgaaagacgaacatatttagcgcaagacgataccaacaggatatgagcctgattgtggagtgaaaagcatgcaatttcaaataggagatatggtgacaagggcatcctatcaaatggatattttgtttcgaatcattcgaattgatgagactgatcagcacgaagccaccgccatattgcatgggaatgaagtgaggctgattgctgatgccaagttgtcagatctcgtcaaggttcaaaaagaggaacagctgactagagagaaaaatgacgaacgaaaaatcaatgaatcgctcgacttactaagacaggactatcagctgctgcgggaaaaacaagagtattatacttctggacaatatcagcatcaggagcagtattttcacatgcctggaaaggtccttcatttagatggagatgcttcatacttaaagaaatgcttggatgtatatgaacgaattggtgtacctgtatacggtgtgcattgccatgagaagaaaatgccaagcatgattgactcgttaattgatcaatatcgaccagatatattggttatcacaggacatgatgcgtattccaagcaaaagggcggcgtacatgatatcggtgcctatcgtcattctcgtcattttgttgaaacggttcaaaaagccagacggaagatccctcatttagatcagcttgtgatctttgctggtgcctgtcaatctcatttcgaatcattgatccaagcaggtgccaattttgcgagctctccttcccgtgtgaatatccatgcgctcgatcccgtctatatcgttgcgaagatcagcttcactccatttgtagatcgaatcaacgtgtgggatgtgctccgaaatacattaacaagagaaaaagggctgggaggcatcgagacgaagggcgttctaagggtaggtatgccatataaaagagatcatgaatcgacataacccgactgatttcagtctggttttttttatgttcaaaaagaaattgcaaaaggatacataattcaccggaaattgagaaaaatagggagaagaaaaggtagaagtttgtcaaaattattttgttgacaatggctcgtgttcgttgatataatttaatttttatttgacaaaaacgggccgttgttgtataattatctcagtgaggtggatgcaatggcgaagactttgtccgacatcaaaagatcgcttgatggtaacttaggtaaacgtttgacgttaaaggctaacgggggccgccgtaaaacaattgagcgttcgggcattttagctgaaacgtacccttctgtatttgtgattcaattagatcaagatgagaattcgtttgaaagagtttcttatagttatgcagatatactgactgagacggtcgaattaacgttcgatgataccgctagctcagtcgcctattaatgggcagtaaactttttgtttactgctttttgttttgcctttttttctgaatgtgaatgggagtctgtccattttttgaaaggggtaaaagaaaggattcgatacaaaataagaaagccacacaagcagtggcactgattcgaattctcgactaaaggggctgtttcgtttgggtagacgccgaggcattatgtcagatgagttcaaatacgagctggcgaaggatcttggattttatgataccgtcaaaaatggaggctggggagaaattcgtgcgcgtgacgcaggtaatatggtcaaacgtgccattgaattagctcaacagcacatggctcaggatgagaatcaacgatagaaaaacggtcagggatacctcgggtgtctctggctttttttgatgaaaaagtcagtgtgctcggcgtaaaagcctatattcatcagatccatcaaatgtgatacaatattgatacttatgtttagatggagaagtaggtgaaatgtttgcgtattttagaaaaagcaccggcaaaaattaatctctcacttgatgttcacggaaagagaccggatggatatcacgaagtggagatggtgatgacaacaatagaccttgcagatcgactagagttgacggagctggacaaggatgaaatccgtgtatcatctcataatcgattcgtgccagatgatcagcgtaatttggcttatcaggcggctaaattacttaaaacaaggttcggtattcgaaaaggggtatccattgtcatcacaaaaacaattccagtcgcagcagggttagctggaggcagcagtgatgcagcggcagcacttcgcggcttaaatcgcttgtggaagttgaacctcacgttagatgaactagctgagcttggagcggagatcggctcagatgtgtctttttgtgtacacggaggcacagcactagcgacaggacgtggggaaaagctgaagcatattgcgacaccgccgcattgctgggtgattttagcgaagccggtgattggggtatctacagctgaagtctatagacaatatgacgcaagcaaagtagaacacccgaatgtaaagcgtatgattgaagcgattgaagcgaaagattataaagagatgtgcggctcactcggaaacgttctagagtctgtgacattaaagatgtatccagaagtagatatgatcaaaaggcagatgaagcgtttcggtgctgacgctgttttaatgagtggaagcggccctacagtatttggcttgattcaatatgaatcgaaggtacaaagaatatataacggactgagaggattttgtgatcaagtatacgctgtccgcatgatcggcgaacaaaatgcccttgattaaatccgtatattaagttatatttatcataaattattcgggttctgggggtaagttcatgaagtttcgtcgaagcggcagattggtggacttaacaaattatttgttagcccacccgcacgtactagtaccgttaactttttttgcagaaagatatcaatctgcgaagtcctccattagtgaagacttaacgattatcaaacagaccttcgaacagcagggaataggcacgttgcttactgtacctggtgctgctggcggagtgaaatatattccaaagattcacctaaaagaagcagacgacgtggtaaacgatatcggagaagctctatcgactcctgaacgtgtacttcctggcggttatttatatttaaccgatgttttaggtaatccatcaatccttgcgaaaatcggtaagctatttgcgaccatctttgcagaccgtgcgattgatgtcgtcatgactgttgcaacaaaaggtattcctattgcctattcggttgcgggttatttaaatgtgccggttgtgatcgttagaaaagataataaagtaactgaaggatcaactgtaagtattaactacgcgtcaggttcgtctaatcgaattcaaaccatgtcacttgcaaagcggagcttagataaaggatccaatgtcctgatcattgatgactttatgaaagctggcggaaccattaacggcatggtgaatttgcttgaggaatttaatgcaaatgttgcagggatcggtgttcttttagaagatgaaggcgtagatgaacgtctcgttgatgaatatgtatcgcttttaaagctttcaaccattgatatgaagcagaagatcattgagatcaatgaaggcaatttccacgagttttttcattcgaaagcttaagaattgaaaacatgtagttgaatgggagagattgatatgacaaaagttgttcaaaccaaacacgcaccagcagccattggaccttactctcaagggattattgtcaataacatgttttacagctccggacagattccattaacggcagctggagactttgtaaatggagatatgaaagaacaaactcatcaagtgttccgtaatcttaaggccgtacttgaagcagcaggtgcttcctttgagacagtcgtgaaagcaacagtttttatcaaagatatggaacaattcgcagaagtaaatgaagtgtacggtgagtatttccatacacataagccagctcgttcttgtgtggaagtagcaagacttcctaaggatgcactcgtagaaattgaagtgattgcattagtaaagtaaacaggcaatcttaacgaaagccgtttggtttcatcttatgcaggaaaagacatcatcatgatgtctttttttcacgaagagaatgtaagcgtcgtcacgaagatgacaaaaaatgtataaatatcccgatatttcaaaaaaagtttaaaaaaagagcaggagaatcaccacaatcgttgaatacctaagtaatgcttttatattgggaaaaggtggtgaactactgtggaagttactgacgtaagattacgccgcgtgaataccgatggtcgcatgagggcgattgcatccatcacgctggaccacgaatttgttgttcatgatattcgtgtgattgatggaaacaatggcttgtttgttgcaatgcctagcaaacgcacgcctgatggagagtttcgcgacattgcacatccaattaattcaagcactcggggtaaaatccaagatgctgttttaaatgagtatcatcgcttaggcgaagaggaagagacaattgaatatgaagaagctggagcttcttaataatacgtgaacctaaaaaggcagctttaagagaaaatggatgttttcttttaaatgctgtcttttttgcgttttttctcttgtttcttatgtctcccatccattagaaaattattgcacttcctcttgtatccttgaaatcaatccttatttaggatatatttttctatggataatagggatattggaggccaatcaatggataagcggttcgcagtgattttagcagcgggaaaaggaacgagaatgaagtcaaagctatacaaagtacttcatccagtttgcggaaagccaatggtcgagcatgtggcagatgaagcgttaaagctttctttaaccaagctagtgacgattgtcggtcatggagcagagaacgtcaaagagcagcttggagacagaagtgaatatgcacttcaagaagaacagctgggaacagcacatgccgtcaaacaagcaaagtcgttccttgcgcaggaaaagggaacaaccattgtcatttgtggtgatacgccattattgacagcggaaacaatggaagctatgttgagcgagcatcaaaaacatcaagcgaaagtcactattttaacagcacgtgcggaagacccggcaggttatggccgtattattcgtgacgaaaccggtgctgttgtgaaaattgtggagcataaagatgcgaatgatgcggaacgtcaagtgaatgaaattaatacagggacctattgcttttcaaatgaagatctcttccgtgtgattgagcaagtatcgaatgaaaatgcacagggtgagtactatttgccagacgtcattgaaatcttaaagaatgaagggcaaacggtagcggcatatcaaacaccgcattttgaagaaacacttggagtcaatgatcgtatcgctctatcacaagcagagcaattcatgaagcgacgtattaatcatcagcatatgaagaatggtgtgaccttgattgatcctgagaacacgtatatttcacctgatgcagtgatcggtgaagatacaacgatttatcctgggacggtcatcaaagggaatgtgaaaatcggtgcagacgccattattgggccaaacactgaaattgttgacagcatcgtcggagaccgcacagtgattaagcaatctgtcgtctgcgatagtgaggttggagtcgatgtgacaattgggccgtttgctcatattcgcccgttgtcgaaaattggcgatgaagtgaaaatcgggaactttgtcgaaatcaagaaaacggttttcggtgaccgcagcaaagcatctcatctcagctatattggagatgcagaggtcggaactgatgtaaaccttggctgtggatcaattacagtcaactatgatgggaagaacaaattcttaacgaagattgaagatggcgcatttattggctgtaattctaatctcgtggcaccagtcactgtcggaaaaggggcatatgttgcagctggttcaacggttacagaagatgtaccgcaggatgcattgtctattgctagagcaagacaagtcaataaagaagattatgtgaaaaatattcataaaaaataatccaaatacccggaggttaccatgtctaatcgttatgctgatgcgaatttaaagatattctctttgaattcaaaccctgaacttgcgaaagaaattgccgatcgtatcggagttgatgtaggaaagagctctgttaaacgctttagtgacggtgaagtccaaatcaatattgaagaaagtatccgcggctgtgattgttatgtcattcaatccactagtgcgccagtcaatgagcacattatggagttgctcattatggtagacgcactaaaacgcgcttctgcgaaaacggtcaatattgtgatcccttattacggatatgcacgtcaagatcgtaaggcaaaacctcgtgagccgatcactgcgaagctttttgcgaacttacttgaaacagcaggtgctacacgtgtcattgcacttgatcttcatgcgccgcaaatccaaggtttctttgatattccaatcgataatttaatggctgtgccaatcttaacaaactatttcgaacagaaaaacttgaatgatatcgtcgttgtatctcctgatcacggtggtgtaacacgtgcgcgtaaaatggcagatcgcctgaaagcaccaatcgcaattatcgacaaacgtcgtccaaagccaaacgttgctgaagtgatgaacatcattggtaacattgaaggcaaaacggcgattctcattgatgatatcattgatacagctggtaccattacacttgctgcaaatgcacttgtggaaaatggagcggctgaagtctatgcttgctgtactcacccagtattgtctggaccagcagtagaacgtatcacaaactctaaaattaaagaattagttgtgacaaacagtattcacttaactgatgacaagaaagttggaaaattcattccgctttcagttgggcctttgcttgcagaagccatcatccgtgtacatgaagaagaatctgtgagctaccttttcagctaattttctgattgaaaaaggccctaggcatcaagcttggggtctttttgctttcatcattctcggcaaataggtttaaaatgatttggttatgggtaattatgagagtagtgacaaaaaagaaataggatggtgctgaatatggcaactttaaaagcaaataaaagaactgacttcaaacgttccacactgcaaaaaatccgtcattcaggacacgttcctggtgtcatatacggaaaaaatacagacaacctggctgtttcattagacagtatcgatttattaaagaccttacgtgatgaagggaagaatacaatcattacgttagacgtgaacggtgaaacaaaatccgtgatggtcacagaattacaaacagacccgctgaaaaatgagcttgtccatgcagatttccaagtagtcgatttgcagcgtgaaattgaagcggatgtacctgttcagttgattggcgaatctaaaggagttaaagatggcggtgtgcttcagcagccactatttgaactatctattacagcgaagccaaaagatatccctcagcatatagaagcagatattacaaacttagaagtgaatgatgtcctaacagtcgctgatttgcctgttcagtcatcatatcaagtgaataacgatccagaagaagtcgtggcatccattttaccgcctcagcaatcagaggttcctgaaccagatagcgaagaggaaccaaaagaacctgaggccattaaagaaaaggataacgatggagaataactggtcatttagagacgtaaccctcccgcggttgcgtcttttgtgctagaatgaaaagaattcatacgttttacatgaggcaatcctattggctcattttttaggcgtgtgctttgtgacaaaggaggtttatggtttcatgattgcatttgttggattaggtaatcctggaaaagaatatgaaaaaacaagacataatgtcgggtttatgacaatagatgaattatcaaaaaaatgggacatccctttaaatcaatcaaagttccatggacaatttggaacgggatttgtttcagggcaaaaggttctacttgtaaagccgcttacatatatgaacttatcaggagaatgcgtgcgtccgctaatggattactatgatattccccttgaacagttgaaagtcatctatgatgatcttgatttgccaactggccgaatccgccttcgtacaaaagggagtgcaggcgggcataatggaatcaaatcgttgattcagcatttagggtcacctgagtttgaccgattccgtatcggcattggacgtcctcaaaatggcatgaaggtcgtcgattacgtgctaggacgcttttctgaagaggagcagcctgatattgcatcagccattcaggcgtctgtcgaagcttgtgaggcggctttaactaagccatttttagaagtgatgaatgattttaacaagaaggtataagaatgataagcaaagcacatactgatcataaaatctcagcaggggaggatcacgtatggctttgcattattactgccggcactgtggtgtaaaggttggcagtttagatgaatccgctgttcaaagtgaagcacttggatttcatcacttaacaaatgaggaaagaaacgatatgatttcttatagggaaaatggtgatttgcatgtacaaaccatttgtgaggattgccaagaggcgctcgaaagaaatcctgattaccatcagtatcatacctttattcaataaaaagctttggtgtagataatagaccaaagcgtttttctgttttaaacaagcagggaggaggagccaaatgaaaaatatacaatcatttatcaaacaaagtgatgattttcagtccatttttaatgggctaaaggaagggttaaaagaacaactgctcgccggactatcaggctccgtcagatctttatttacagccgctatatcagacgaacttaagcggccgatgtttattgtgactcacaacttatatcaagcgcagaaggtcacagatgatcttgccagtgtgatgtcagatcgctcggtccttctttatcctgtgaatgaactcattgcttcagaaattgccgttgccagccctgagcttagagctcagcgtctagatgttctgaaccggctggcgaatggagaaaaccccattatcgtcactccggctgctgcggtgcgtagaatgcttccgccagttgagctctggaaggagagtcagatccatttaaagcttggtgaagaaattgatttggaggcgttttcaaaacaacttgtacaaatcggttatgaccggacgtcgatggttgctgcgcccggagattttagtgtgcgcggaggaatcattgatatttattcgttaacggaagatcatccaattcgtattgagctgtttgatactgaagtagactcaattcgaacgttccactcggatacacagcgttcattagaaacacttcaagagattaaaatcggtcccgcaaaagagctgattgtgagagggcctgaacgagtgagagccattgaacagcttgatcaaggacttgcgaagagcctaaagaaattcaactcagaccagcaaaaagaattgctgcatcaacatatttctgctgatcgagagaagctgctagaaggaatcgtgacacaggaaatgacgaagtacctgtcctatttctatgaaaaacctgctagtttgctagattacacttcacaggatacgattattattttagatgaaattagcagaattcaggagatggaagaacagcttgagcaggaagaagctgattggacaattagtctgcttgaagaaggcaacatccttcatgatttatctctttcttttccgttccaacaactaatcaatcagcaatctcggtcgattctgtactactccttgttcctgagacatgtccagcagacaaatccgcaaaatatcgtcaatgtatcgagtaagcaaatgcagaatttccacgggcagatgaatgtgctcgcaagtgaaattgaacgctacaaaaaacaacaatacacggttgtcttcttaggtgcggatgaagagcgtacagacaaattgtcttctgtcttacatgattatgacattgaagctgctcttgccaagccggacgcagagcttgtaagcggacaggtgtatattttacaaggtgagctacaaacaggctttgaactgccgttatcgaaaattgccgtgatcacagaaggcgagctcttcaaaaaacgtgtgaagaagcaggcacgtaagcaaaagctgaccaatgcagagcgaattaagagctattccgagcttcaagtcggcgattatgtggtgcacattaaccacgggatcggtaagtatttaggaattgaaacgcttgaaatcggcggcattcataaagattatttaaatattcattatcaaggaagcgacaagctttatgtaccggttgaacaaattgatcaggtgcagaagtatgttggatcagaaggtaaagaaccaaagctgtacaaactaggcggcagcgattggaaacgtgtgaagaaaaaagtggagtcatctgtacaggatatcgcagatgatctcattaagctgtacgcagaacgtgaggcaagtaaagggtatgccttctcgcctgatcatgagatgcagcgccagttcgaatcagcgttcccttaccaggaaacagatgatcaaatccgttcgattcatgaaatcaaacaagacatggagcgggagcgtcctatggaccgcctgctttgtggagatgtgggatatggaaaaacagaagtggcgattcgagccgccttcaaagcaattgctgacgggaagcaagttgctctgcttgtgccgacaactatcttagcgcagcagcattttgacacgattatggaccgattccaagactatcctgtcaaaattgctcagctgagccgtttccgtacaagaaaagaaacaaccgagacgttaaaaggtttgaaaaacggaacgatagatatggtgatcggcacacaccgtttgctttcgaaagatattgtctataaggacttaggtctgttgattattgatgaagagcagcgttttggtgtgacgcataaagagaaaattaaacagatgaaagccaatatcgatgtactgacattaacggctacgccaattccgcgtacgctgcatatgtctatgcttggcgtacgggatttatcggttattgaaacaccgcctgaaaaccgtttccctgttcaaacctatgtggtcgagtacaatggcgctttagtcagagaagcgatagagcgagaactagcacgtggtggtcaagtgtacttcctgtacaaccgtgtcgaggatattgaacgcaaagcagatgaaatctctatgctagttccagacgcgaaagtcagctatgcacatgggaaaatgagtgagaacgagctggaatcagtgatgatcaatttccttgaaggtgaatcagatgtattggtcagtaccaccatcatcgaaacgggagtcgatattccgaacgtgaacacgctcatcgttcacgatgcggataaaatggggctttctcagctgtatcagctaagaggacgagtaggacgctcgaatcgtgtcgcatatgcttatttcacgtatcgaaaagataaagttctgtctgaagtagcagagaagagacttcaagctattaaagaattcacagagctcggatcaggatttaaaattgcgatgcgtgatttaacgattcgaggagcaggaaatttacttggtgcacagcagcatggattcattgattctgttggattcgacctctattcccaaatgctgaaagaagccattgaagaaagaagaggcgatacaacggctcaagataaattcgaaccggaaatcgatctacaaatcgatgcttatatccctgacacttacatttcggatggaaagcaaaagatcgagatgtataaacagttcagagcgattggatcaattgaagagcgaaaagagcttcaagatgaaatgatcgaccgattcggtgaatatccgcaagaagtggcggatttgttcacaattgcgacgatgaaagtatacgcagtgcaggaacgtgtcgaattgatcaagatggagaaaggcattgtcagactcacccttgaagagcaagcaagcagtgacatcgacggtcaaaaattatttgcacttggcagtaaatatggccgtgatattggcctaggaatggaaggcagcaagctaattatttctgtccagacgaaaggtaagaagacggaggaatggcttgacatcgttctgaatatgctacgaggtcttcaagatgtgaaaaaggaaaccattccatcttcataaaaatttgtttgtctctcgtgtatattacgtttgatgtgacggatactaatctcagggtcaagtggtgaatgttgcataaagtggacgcttttgttccattcacccaacacatcatcaaacgaaagagaggcagcagtgaatgaaagcaactggaattgtacgccgcatcgatgatctaggtagagtggttattccgaaggagattcgcagaacattgcgcatccgggaaggagatccacttgagattttcgtcgaccgcgatggagaagtaattttgaagaaatattcgccgattagtgagctaggagactttgcgaaggaatatgctgatgcattattcgacagtttgggtcattccattctgatttgtgatcgagatacgtatattgctgtatccggcagttcgaaaaaagagtacttaaataaatccatcagtgatttacttgaacgaacaatggaccagcgtaattctgtattagaagaaagcaaaaaagaaattcaacttgtcgatggtattgatgatgacgtatctgcttataccattgcacctattgttgcaaacggagatccgattggcgccgtcgtcttattttctaaagagcgttcaatgggggaagtggagcataaagcggcagaaacggcagctggcttcttagcccgtcaaatggaacactaggtctaataattgtatatcattttgataaaacaaaagaatgccgatgaaatcattttgattttgtcggcgttttttatatggaatgaaacaaaacgaggaatgtgccgtctactccttagaaagaaacggcttttcattcacgtatgatataatgagtgcgtttaactgtagatctatttttaaaggagtcatccatgaaaaatgctgtgaatcagccgcattggcttttccaaggtgcggtgattttgaccatcgcaggcttgttatcaaagatattaagtgccgtttatcgtgttccgttccagaacatcgtaggagacactgggttttatatttatcagcaagtgtaccccttccttggtattgcgatcatgctcggcaccacagggtttcctgtcatggtgtccaagcttctaagtgaccatggggaagagaatcgacagatcattacacgggtatccttggtctatatcaccttactgagcctagtcttatttctttgtctttacataggagcaggcagaattgcgagccttatggcggacagtcaattgatcctgcttatccaaatgagtgctttcgtgtttttatttctgccgcttaccgtgatgctgagaggcgtttttcagagtgacggtatgatgcttccaacggctgtttctcaattggttgagcagctcatcagggtaggcgtcctgcttgttttatccttctatttcgtcaagcatggttattcgctttatgaaacaggggcgggtgcagttttctcttccatagcgggaagtgcgacctcgcttatactgcttctttttctttggctgacttaccgaaaacagtcttctacacgtatggcagtcaagcaggcgacacttcggaaaaaggatgttttgaagagtttggtgctgtatacattgacgatttgtgtcagcggactgctcattttatggatgcaaatgattgatgcttttcatctgtatgcgttgctgcgcagtgagggactgagtgaagccgcggcaaaggcggcaaaaggtgtgtatgaccgagggcagccgtttttacagctagggacagtgtttgccattagcatcgggacttctcttgtgccatttttatcagcggccatgaggaatggagagcatgaagtgatcaggcaaaaagtacggacatcgtttaaaaccacgttggttttagggattggttcagcagttgggctgatttgtattctttcgtcagttaatacaatgctttttcgtaatgatttaggaaccgatgcgctgcaaatattctgtatttccatcgcatttacatcgattgcgattacgcaagcagctttacttcaagggctcgggcatactgtgtatccggctgttgtggtactgctcagtgtgctggtgaagtggatacttacgcttgcactggtcccgctatttggcatctacggtgccgcatggtcaaccgtgtgcggttttcttgctgccgctctgctcaatgccgtttatttgaaacataaagggtggatttcgttgagagagctgttcccagtgaaaattcttttatcagccgctttcatggccattgtcttaatagggtatcaggcgctgttttcttgggtcattccctttgaaaaacgtcctttttccgttttagagagcctgacgtcagtttttattggtggtttcgcctttttatatagtattcttaagctagaagtatttacggacgaggaatggagactcattccattaggagaaaagattttatattttaaacagatgagagggaatcaaaatggcaggtaagattaccgtcgtcggtcttggggcaggcgacatggatcagctgacgctcggtgtttacaagcagctgaagcaggtgaaagaagtatttatgagaacgcaggaccatccgctgaccgcagagttgatgcaagaggtcccatcgctgaccttttttgatgagatttatgaaaagcacgatcagtttgattcggtctatcaggaaatcacggaaattttatttacagaggctgctgaaaaggagattgtgtacgcagtaccaggtcacccatttgtcgcagaaaagaccgtccagctattagtttctcagcagcaagagcgcgggattgaggtgtctgttgcaggtggacaaagctttttagatgcgacgtttaactccttgcagatcgacccaatcgagggattccaattcgttgacgcaggagatatgagagcggacgatctgaaattgacccagcatgtccttatttgtcaggtatatgatcagatcaccgcttcgaatgtgaaactcacgctgatggaaaagcttccagacgattatgaagtctatattgtgactgcggctggaagcagcctggaacaaattactgccgttcctttatttgaacttgatcgagatgtgtcgataaataacttaacaagtgtttatgtacctccgattcaagatgaaaagctgctttatcaacaatttgacaccttccgtaacgtcatccgtacattaagaggtccgggcggctgtccatgggatcaaaaacaaaccaatgagtcactgaaaccctatttaattgaagaatgctatgaactgcttgaagcgatagatgaagatgatccagaccatatggtggaagagctcggagatgtgatgctgcaggtgttacttcatgctcaaatcggtgaagatgacggctttttctcaattgatgatgtcatccagcatgtcacagaaaaaatgattcgtagacatccccatgtgtttggcgacacaaatgtttctgaagcagaagaggtggtcgtcaactgggaaaaaatcaagcagcaggagaaaccggagcgggcagcctccatgttgcaatccatcccggcgacgcttccagcactaacaaaggcatataagctccaaaagaaagccgccaaagtaggctttgattggacagatgtgaaagatatttggaacaaatacgaagaagaaaagcaggaatttctcgttgaagtggcagagaagccggacgaaagtgcaacgaagcagatgaaagatgaatttggagatcttttgtttgttctcgtcaacattggcaggttctatcagctagagcctgaaacggcgctcgcttccgccaacacaaaattcatgcgacgttttcagcatatcgaacaaaaagcaaaggacatgggacgttcattagaggacttaacgctagaggaaatggacgatctatggaatgatgccaaacatatagaaagaggtgagtaaacatgagattagataaatttttaaaagtgtctcgtttaataaaaagaagaacattggcaaaagaagtcgctgatcaaggcagaatttctattaacggcacacaggcgaaagccagctctgacgtgaaagaaggagacgagcttaaaatccgttttggtcaaaaactagtgacggttcaagtgaacgagttaaaggacacaacgaaaaaagaagaagccgctggcatgtatactgtgctaaaagaagaaaaaacagcggaatagggcttgttctaaatgatcctcctgtcacatacaatgcagtaacaatgcaagtatgagatatgggggatgtataaatgaatcaatattataatcaacctcaaggcacgaagctgtcatcagaagcggaacacaatatcacaatgcgaaacagaaagcatttagatattaccggcgtcaaacaggtggaaagctttgataatgaagaatttctgcttgagacggtcatggggattctcgctatccgtggagaaaatctgcaaatgaaaaacctagacgtcgaaaaaggcgttgtgtcgattaaaggacgtgtctttgacttaatttatgtagatgagcagcacggggagaaagctaaaggattttttagcaagctgtttaaatgacgctgacagtccagttttatacgatgctttcgatggtagcgatgggcatctggctgggcgcatcgcttgatacgtacaagctgtttgtgaatcgggaaaagacagcaaaatggcttttgatcatacacgatctccttttttggctggtacagggactcttattcttttatgttctgctgctgacaaatgagggagaattcagggtttatatctttctagctgttgcactaggtttctcgatgtatcaggcattgatgaaacagctgtatatgaatattctcaagtttatagtgatgtgtgtgtatcaagccgctctcatcttgaaacggctggtcaagtccatcgtcttccagccaatccgctggctgatgaccttaatcataagtgctattatgttcttgctccacttgctcttacgtcttgttcattttacgtttcggctcgtgtggaaggtgctgtccattgtttgttatccgctcatctggttacttaatgtgaccatcattcatcggattcccgaaaaatggcgaacatcaatgagattgtttttctctaaaggagcaggaattttacaagggaccaagaaattatctggtaccatcaaaacgaaatggaaacaattctggacaaagtaagagaggaggccttcaaccttgaacaagagaaaaagaaatatcgcacaaattcaaaatgattatcaaaaacaaatggaacagcaagcacagcgcttaaaacgcaaacgccgtggactcctaagaaggcttaccgtgtttggtgtgatcgtgctcatgtttgctgtcttggtgacaagtgccctctggtcgcaatcgtcttcattaaaggaaaaagaagagaagaaggttgcactcgaaaaagaattgaagcaattacaaacaaagcaggaagatatttctgatgaaattaaaaagctgaaaagcaaggaatacgtactcgaactggcacgacgggactattatatgtccaaaaaaggcgaaaaaatctttgatgtgggcaataagagcgattagccttgttgacacttaaaattcagtttatgtataattgaacaaatgagatttttttataagtctaaggaggagcactttttttatgtcgattgaagttggcagcaagttacaagggaaagttacgggcattacaaattttggagcttttgtggagttgccaggcggttcaactggtctcgttcatatcagtgaggtagccgataactatgtaaaagatattaatgagcatttaaaagtcggtgaacaagttgaagtgaaagtgattaacgttgaaaaagacggtaaaatcggcttgtccattaaaaaagcaaaagatcgtcctcaacaacaacaatcaagaccgagcagaaatgatttccgtccgaaggaatcgtttgagcaaaaaatgaacaaattcttaaaagatagtgaagaccgcttaacatctttaaaacgtaacacggaatcaaaacgtgggggacgcggagcaagaagaggttaacttgttgctgctttctatatatctttcacaacaaagcacctgctgaccgcaggtgctttttatcttgatccatacgacattttttgagatttcgtcatttaatttaaaacttcctattgacggacaagcgattcctttgtattatagatcttgtgcttcttagcgcattttcattatggcggtgtagctcagctggctagagcgtacggttcatacccgtgaggtcgggggttcgatcccctccgccgctatccttttgattagaacataaaagcaaggcccgttggtcaagcggttaagacaccgccctttcacggcggtaacacgggttcgaatcccgtacgggtcatcttcgaaaacagccttccttaggaaagctgtttttttgtgtcttcgtaaaattctgatgaaagacatcgactttcatgaaagtatgcctctttgacgaataaagcgtcgaacgttttatggaaacgacaacttcttttgacaaaatttctttttcaccttcgctataatgacaagcaacgaatatcaggtgggggatgaaaagatggaaaaactagaaagaagaactgatttaacaggagcggggtttgaaagaatcagtacagggttaaaaaagatgaaaaacctgtttcttcatcatacgcattctctttttttctataaagggtttatttatgtcgttcttggttttttattaggacgagcctttatattatctgaaattatgccgtttgctctgcctttctttggctccatgctgcttatcaaaagagataagtccatgctcgcttgtctcgctttacttgctggagctatgacgatatcacctcaaaatgcattgtttgtgtttgcgtcgctgatcgtattccttctgatgtccaaggtggtttctttcatcatcaaagacccagtgaaaacattgccggttgtcattgtgctgtcaatgctgatcaccagaggagcatttgtttacctagagcaaggtgctgtgcaaagctacgattacgtcatggcgggtgtcgaagcaggacttgctttcattttgacactgattttccttcaaagcctgccgatttttacagtcagaaaaatcaaacactccttaaaggttgaagaaattatttgttttatgattttgattgcctcagttttaacaggtctggccgggatcacatttcaaggaatgcaggcagaacatattttgtcacgatatgtagtgctgagctttgcttttattggaggagcgagtattggttgtacagtgggtgtcgtcactggattaattcttggtctcgctaatatcggaaacctttatcagatgagtcttcttgccttttcaggtttattagggggattgctgaaagaggggaagaaagcaggagcagccattggcttaattgtgggttccttacttatttccttgtacggagaaggatcagcaggactcataaccacgctatatgaatcattgattgcggttgcgctcttcttgctcacgccacaatcagtgacctctaaggtagcgaaatatattcctggtacggtagagcatgtacaggaacagcagcaatacgcccggaaagtacgagatgtgacagcaaaaaaggtagaccaattttctaatgtatttcatgcgctgtctgagagttttgcgacattctacgaatccattcctgaagaaaagaaacaggaagaggatgtagatctttttttaagtacgatcacagaacgatcctgtcaaacgtgctataagaaaaataaatgctgggtgcagaactttgatacaacctatgaactgatgaaacaagttatgcatgaatctgatgaaaaaacctacgagcaaaaccgaaaattgaagaagaaatttagccagcactgctcaaaatcaaaacatgtcgaggaattgattgaagaggagatcgcttactataaagccaatcagaccctgaagaaaaaggtccaagacagcagacgactggtagctgaacaactgatgggcgtttcacaagtgatggaggatttttcccgggaaataaaacgggaaagagaacagcattttattcaagaagagcagatgatagaagcgcttcaacactttggaattgaaattcagcaagtagaaatttatagcttagagcaggggaatgtcgatattgaaatgagaatcccatattgccagggacatggtgaatgtgaaaaaatcatcgcccctatgctctcagatattttagaagaacagattttagtcaaagcagagcagtgtgcagagcacccaacaggctattgccacgttgtatttggttctgcaaaatcatatcgagtggctacaggcgtagcgcatgcagcaaaaggcggaggattagtgtctggagacagctacagtatgatggagctgggtgcgggcaaatatgccgcagctattagtgatggaatgggcaatggagcaagggctcattttgaaagcaatgaaacgattaagctgttagaaaaaatattggcatcaggtatcaatgaaaaagtagcgatcaaaaccattaatagtattttatctttacgaacgactgatgaaatctattcaacattagatttatccattattgatttacaggatgcgagctgtaagttcctcaagattggttcaacacccagctttattaaacggggtgatcaggtgatgaaggtacaagcaagcaacttaccgattggaattattgatgaatttgaagtggaggttgtgagtgaacagatgaaggcaggagatctgctgattatgatgagtgatggcattttcgaaggaccaaagcatattgaaaatcatgatctctgggtgaagcgcaaaatgaaaagctttaaaacagaagatccgcaagagattgctgatttattaatggaagaggtcattcgaacaagatcgggtcaaattgacgacgatatgacggttgttgtcatcaggcttgatcacaatactccaaaatgggcatccattccgacgggtacattctatcttgagaaacaagagatttcttgaaatatcgtataatatgaaattcttctggcgatgatggggatataaagcattcagttacgatcccaggaggaatgaagatgcgaaaaggtcacgtaaaccaaatcttattgattacagatggctgctcaaatcacggggaagatccacttgcgattgcctcattggcaaaggaacaagggattacagtcaatgtcattggcattatggaggaaaacagacacgatcatgaagcaatgaaagaagttgaggggattgctctagcaggcggaggcattcatcaagttgtctacgtccagcagttatctcaaacggtacaaatggtcacaaaaaaagcgatgacacaaaccttacaaggtgttgtgaataaagaattgcagcaaatacttggcaaagatactgaaatagaagagcttccgcctgataagcgcggggaagtgatggaagtagtcgatgagttaggagagacagttcaccttcaagtacttgtgcttgttgatacaagtgcaagtatgaaaccgaagctgccgaccgttaaagaagcactcattgatctttccattagtttaaattcaagaattggtgaaaatcagtttgggatgtgtatatttcccgggaaaaactcagatgctgaaattgtgttgaattggacgcctcgattcgattcactatcatctattttcccgaaactgaccacaggaggaatcactccaactggaccagcgcttcgagaagcgctccagcatttcaaatcagttcgttcgcgtaaagggctgcttgaagcaaaggaagagcatgatgaattcggcttctaacattccgttaggcacggtgattcaagggaaatggcatcaccatcattaccgcattgtaaaagagctaggaaaaggggcgaacggtattgtctatctagccgaatcgccaaatggtcaagtagcccttaaagtgagtgatgacagtatgctcattgcatctgaagtcaatgtattaaaatccttttctaaggctcctgtgaaaaccatggggccttctttttatgatatggatgatgcgatttatcccggcatgcttcaaaagcgttccttttatgtgatggagtatgtcagaggcccattactgctggaatttgtcaaacaaaaaggtgatgagtggatcgtcgttttaatggttcagcttttatctaatttggctcatttacatcaagaagggtggatatttggtgacttgaagccagataatctcatcgtgtcaggtcccccggccgcgattcggtgcattgatgtagggggaacgacaaaagcgggcagggcaatcaaggaatatacagagttttttgatcgaggctattggggattcggcacaagaaaggcagagccatcctatgatctatttgccttaagcatggtaatggtgaattgtgcgtataagaaagaattcaaaaaaggggcagaaccagaaaagcagctttacagagccattgaaggacatcctttattaaagcaatatgagagggtgttaaaggctgctctacaaggtaaatatcaatcagcggcggctatgaagagtgcgatgctgaaagaaggacagctgatcgcttcaagaaaagaaaagaagcaacagaaaaaaaacgggcaaaagcccgctgttcaacaaaatcaacatgtgacttcacgatcgagagttgcagcagcaaaaagaacacaagtacgcaaaaaatcgggtgggctttttgaaactattcttatcgtgtgcagtgtacttgctctttactgtgcatatgtagttttgttcctgctatagacctgtaaaaaagcaggcttcatctttgcttggagctactgaaagtgataggatatgtatatctttaaattacctgctctttgtgaggaggaagttgtgaatagaattgaatcatttttgaaaaaacatgatgtttaccttgaaaatacgacagtcattgtcggggtttctggcggaccagattccatgcttttactgcacgaactaaacaaacgtcgcaaagattcctttcagctgattgcagcccatgtagatcacatgttcagaggagaagaatcttttgctgatttggcatttgttgaggcatactgcaaggagcaagaaattccttttgaatcggcccgcatacaagttgcccaatatgcaaaagaaaaccacttaaacaaacaggcagctgcaagagagtgcagatatgctttctttcgtcaattgatggagcaatacaacgctcaatttatagcgcttgcacatcatggggacgaccaagtagaaacaatgatgatgaggcttgtgagagggacagttggaatagggctcgcaggtatccaagcaaaacgtccttatcaaggtggatggctgattcggccgctcattggatattccaaggatgacgtgctgaccgcttgtgaaaaagaacatatcccctatgtcattgatcaaagcaatcacacagatgactacttgagaaaccgggtaagaagacacattcttcccgtgttaaaagaagaggcacctcatgtacatgaaagctttcagtttgtaagtgatatgctgactgaagatgagcaatacttgcaggcattaacaaaggaacaaatgaaccaagtgataacgaatcaatcgcctaagcaaattaagatcaaaacgaagcctttgcttgacctgcctttgcctttacaaagaagaggcattcaactaatattaaactatctttatgaaaacactcaatcagcgttttcaaaccagcatattctagggactttggactggttatctcataccgaacaaccgtctggatcattagatttgccaaaaggtttacaagctgtcaagtcttatgattactgtatgtttacctttgaacgatcgcttgtactagaccagtcttatgctcttcacttaaagggcgaacttggagagaagcttttccttccaaatgggcagtctattgtggtatcaaatcatgttccggaggatgcacggaacggaaaccattttttcttgcttcaaaaagatcatgttcgtttccctttgatcattcgctcacgaaaaaatggtgatcgaattaaacttaaagggatgaatggatcaaaaaaggtgaaggatatatttattgataaaaaagtgcctcttgcagaaagagacagctggccgatcgtcactgactcggatcatcaaatcatctggatcccaggtctgaaaaaatccgtttttgaagaaattgatatgacaaacagcgatctcattgtattacaatatagacagcatgaaaatttgtagggggcaagcaaaagcatgaaacaagatattgaaaaggttttgatctcagaagaagagatccagcaaaaagtgaaggaactgggtgcaacattaaccagcgattatgatggtaaatttcccctggctattggtgttttgaaaggggctcttccatttatggcagacctgatcaaacacattgatacatatttagaacttgattttatggatgtatctagctacggaaaatctaccgtatcttcaggagaagtaaagatcattaaagatctagatacttctgttgaaggaagagatattttaattatggaagatatcatcgacagtgggttaactttgagctatctggtagagcttttccgataccgtaaagcaaactccataaaaattgtgacattgcttgataaaccaagcggtcgtaaagcagacatcaaagcagattatgttggatttgaagtgccagatgcatttgttgtcggctatggattggatttcgctgaacgttaccgaaacctcccgtatattggagtgttaaaaccatctgtttacgaaggctaatcagcatacgtatacatgaggttattggttgtattggaatgattttctatgatactattgaacatagttgtgcttactgtgggaggaggtaaggaatgaatcgggtttttcgtaatacgattttttatatacttattttattacttgtgataggggtagtcagttggttaggatcccctaatcaaaagcctgagaacatgtcttacagcaaattttcgcaaaatctaagtgcgggaaaagtggagagtatctccattcagcctgtaagaggggtttatgaaattcgtggtcaattagatggcgcgaagaaagatgaatacttcattacccatgttccagatggtcaaggtgttgaccagatttacagtgcactgaagaatacagatgtaaaagtagaacccgcacctgaaacaaatggatggctgcaagttttgacaaccatcattccgttcatcatcatctttatcctgttcttcttcttattgaaccaagctcagggcggtggaagccgtgttatgaactttggtaaaagtaaggcgaagctttacacagaagagaagaaacgtgtgaaatttaaagatgttgccggtgcagatgaagaaaagcaagagcttgtagaagtggttgaattcctgaaggatccacgtaaatttgcggagcttggcgcaagaattcctaaaggggttttactagtaggacctccaggtacaggtaaaacattacttgcgagagcatctgcaggagaagcaggcgttcctttcttcagcatcagtggttctgacttcgtcgagatgttcgtcggtgtcggtgcatcacgtgtacgtgatttattcgaaaatgcgaaaaagaatgcaccatgcttgatctttattgatgagattgatgcagtgggtcgtcagcgtggagccggtcttggcggtggtcatgacgagcgtgaacaaacgcttaaccagcttcttgttgaaatggatggttttagtgcgaacgaaggtattattatcatcgctgcgacgaaccgtgcagatatcctagatcctgcattgttgcgtccgggacgctttgaccgtcaaattacggttgaccgcccagatgtcattggccgtgaggaagtactgaaggttcatgcgaaaaacaaaccgcttgatgatacagtgaacttgaaagccattgcaagcagaacacctgggttctctggagcagatcttgagaacttactaaacgaagcagcacttgttgctgcccgtcataacaaaaagaaaattgatatgcgtgatatcgacgaagcgactgatcgtgtcatcgctgggccggcgaagaaaagccgcgtcatttcgaagaaagaacgtaatatcgtggcttaccatgaagcaggtcataccgtcattggtcttatcctagacgaagcggacatggtgcataaagtaacgatcgttcctcgtggtcaggcaggcggatatgcggtcatgcttccaagagaagaccgttatttccaaacgaagccagagcttcttgataaaattgtcggcttgctcggcggtcgtgttgcagaggaaattacgtttggtgaagtaagcacaggcgctcacaacgacttccagcgtgcaacaggcattgcaagaaaaatggttactgagttcggtatgtctgataagcttggtccgcttcagttcggtcaagcacaaggtggtcaagtgttcctaggccgtgattttaacaacgagccgaattatagtgaagccattgcttacgagattgaccaagaaattcagcgtttcatcaaggacagctacgaacgtgcgaaacaaattctcactgagaacaaagataagctagaaattatcgcacaagcccttctagaagttgaaacattagatgctgaacaaattaaatctctttacgaaactggaaagcttccagagcgtgtatacgcagatgacgaagagaagaatgatgatgtgaaagtgaacatcaagaaaaaagaagaagatgaggagatctaatctccctctgtgaaagctgccgggatcaccggcagctttttttatttcaattcctgaatggatcggtttcgaattgtttacaaatggaactcaattcgtgtatggtatgatagaaagtcgaaaaatgctctttttgagaaactattcaaagtggtgatgaagttgttactcgtgatagatgtagggaacacaaataccgttttaggtgtttatcataatggcgaactaaactaccattggcgaattgaaacaagccgtcataaaacagaagatgaatttggtatggccatcaggtctttatttgattatgtcgggctaatgtttgaccaaatagaaggaattatcatctcgtctgttgtcccgccaatgatgtttgcattagaaagaatgtgcgagaagtactttcacataactccccaaattgtagggcctggaatgaagactggattaaacattatgtgtgacaatccaaaggaagtcggggctgatcgaattgtgaatgcagtagcggcgattcacctttatggggcacctctcattgtcgtagatttcggtacagcgacaacctactgttatatcaatgaacaaaaacaatacatgggtggggcgattgcacctggtattaccatctcaacagaggctttatatacaagagcagcaaaactgccgagaattgaaattgtccgtccagaacacattgttggaaaaaacaccatcagtgcgatgcaatccggcatcctttatggatatgttgggcaagtcgagggaatagtgaaacggatgaagcagcaagcgaaacaaacaccgaaagtcattgcaacaggcggtttgtcgacattgattggaaatgaatcagattgcattgatattgtcgatccgttcttaacattaaaaggacttcaactcatttatgaacgtaatcgtgtcggtgtactataggaggttaaaaatcgaatggattacttagttaaagcgttagcatatgacggaaaagtccgagcatatgctgcaaacacaacagatacaatcaatgaagcacaaagaagacaccatacatggccaacagcatcagcagcgattggcagaactatgactgctacagtcatgatgggtgctatgctgaaaggcgaaaataagctaacggtcaaaattgaaggcggtggaccaatcggtgccatcattgctgatggaaacgcaaagggccaagtgcgcggatatgtctcaaacccacaagtccactttgacttaaatgaacatggcaagctggatgttagacgtgcagtcgggacatctggaacgttaagtgttgtgaaagatatcggactgaaagatcactttacaggacaaacggagatcgtctcaggtgaaattggagatgacttcacttattatcttgtctcttctgagcaagtgccttcctctgtaggtgtgggggttctcgtcaatccagataactcgattctcgcagctggcggtttcatcattcaattgctgcctggaacagaagatgctgtcattgaaagattagaaaagcggctctcaaccattgaacccatttctaaactcattgaaaaagggatgacaccagaagaaattttagaagaagtactcggagaaaaacctcaaattttagaaactgtacctgtcgaattttcttgtaactgctcaaaagaacgttttgctaatggcattatcagcctaggaaaagccgaaattgacgatatgattgaacaagaaggacaagcagaagctcaatgccatttttgtaacgaaacgtatgtatttacaaaagaagagctagaggagctacgtgaagaaataacccgctaagctctaagcagcgggttttctttttagaatggaaaggagacgaaagatgagactgaaagcaagagtggtatggacatttattctcgtgttgcttatgatcaatgccgttgtcattgcatatgtattaacaaagtcgcaaatgtcacaggcttcttcaaacgggaagagcggtgaagaaatcgcgtcgattggaaaagagaaggtgacacgtcaagaatggttaaagaagatggaagaccgctatggaaaggcaacacttgagcaaatgattaatcagaaggtggtcaatcagcttgcgaaagaaaacaagcttgaggtgtcctcaaaagaaatcaatcgtgaattgctgatgcttaaggcggtatctaataatttctacgaagatggacatacgagtgaaaaggactggacagaacagattcgttatcaaattttattagagcagcttttaacgagagatgctgtcgtttctgaaaaagaagcgaaatccttttatgaaaaaaacaaggacttatatcaatatgatgattcataccgtattcgtcatatcgtcgtgaagacaaaaggtgaagctgaaaatgttttgaaggatctgaaaggcggatctagcttcgaggcggtggcagctgaacgctccattgaccgctacacctctccatatggcggagatcttgggtttgtgacggaagaacaagaaagtatcccagccctatacatacaggaagctcaaaagcttcagccagatgaatggacaaaagaaccgatcgagaccaaaaacgggtatgccattattcaattgaaagaaaaattagatggccgctccttctcgtatgaagaagtcaaaaatcagatcaaaaggcagattgccatggaagatctaggtgaaaaggcgaatgtcaaaactctgtggaaagaagcaaaagtcacatggttttacgatggcgagcaggactaaaagcattgacaaaatttttcgaaattgataatttaatattaatacaataaaattactcggagatagaggtgttagtgatggctcgtattgcaaattcagtttttgaactaataggaaatacaccagtcgttaaattaaaccgtttagtagatgaagacagtgcggatgtctacttgaagcttgaatatatgaacccgggcagcagtgtgaaagatcgtattgcgttagcgatgatcgaagatgctgaagcgaaaggtactttaaaagccggcgacacgctcatcgaaccaacaagcggaaacacaggtatcggtctagcaatggtagcggcagcgaaaggaattaacgccattctagtgatgccagacacaatgagtcaggagcgccgtaaccttttacgtgcttatggtgcagagcttgtattaacaccaggtgcagaaggaatgaaaggtgccatcaaaaaggcagaagaattagcagaagagcacggttacttcatgcctcagcaatttagcaacgaagccaatgcggagattcaccgtcgtactacaggaaaagaaattcttgaacagtttgacggcgagcttgatgcatttattgcaggtgttggtacgggcggcacaattacgggtgctggcgaagtcctaaaagaagccatcccatcgattcagctttatgcggtagagccgacagattctcctgtattatcaggcggaaagccgggcccgcataaaatccaagggattggagcaggttttattccttccatcttaaacacggaagtatatgatggcattatccaagtgaaaaacgaagatgcatttgagcttgcaagaaaagcagcgaaagaggaaggaatccttggcggtatttcttcaggagcagctatttacgcagcacttcaaacagcgaaaaagcttggtaaagggaaaaaggttctcgcaatcatcccaagtaatggggagcgttacctcagcacacctctttatcagttcgattaaaccaattaccccagcatttgctggggtttttttatgaaatctgtagatggaaagcaaatactattttctaaataaattggattgcattacaataagattaatgaaaatgaaaaaggatgataacatgacacaacgcaggccgatgggcatcaaaattccttttacgaaagatgcattcttggaaagatacgaacaactaactgctggcgaaacacaccatgttctgcttgaaagtgctcgcggcggttcctacagcattgctggtattcacccaatcgctaaagcgaagggaaaagacgggatgacaaccatccattatcaagatgaggtgctgtttaaagaaggcgatccattcagagcgtttacggattggttccaaacccttcaaaccgaaacgaatgaggaataccctgattttcaaggcggggcgattggatttttaagctatgattatgctagatatattgagcattttaagatgctgtccattgatgacctgaaaacacctgatctttattttctcgtgtttaatgatgttgcagtctttgatcataaggaaaatatgttgtggctgattactcacacagagggagcggaacctgtgagtgtcactcatcaaagacttgaagatttgaagcaaaagtggacaagctctgtaatcgaatcagcacaatcacctgttaatgaaccttctgcagaatttgtaccagcagcaccttttactgaagagacctttggagaagcagtagagaagattaagcaatatatcgcaagcggtgatgtgttccaagtgaatttatccatcagacaagatgaacagctccacacccacccttatgatttatacaaaacgttacgtcaaatcaatccatctccttatatgtcttatttgcacacgcctgatttccaaattgtttgtggatctccagagctgctgattaagaaaaaggggactcaattagaaacaagaccgattgcgggtacaagatcaagaggcaaagacgatgctgaggatcaagcgctggcaaaagagctcattgaaaatgaaaaagagcgcgcggagcacgtgatgctcgtcgatcttgagcgaaatgatcttggacgcgtgtccacttatggctcagtaagagtgaacgaatttatggcgattgagaaatattcacatgtgatgcacattgtatccaacgtacaaggggaactgcgtgatgattatgatgcagtagatgtcatgagagccgtattcccaggcggcacaattacaggtgctccaaaggtgagaacaatggaaatcatagaagagcttgagccaacaaggcgtgggctttatactggatctataggctggtttggatttaatcaagatatgcattttaacatcgtcattcgtacggcgtactgcactgaaggcaaagcctttatgcagtcgggtgctgggatcgtcattgattctgtaccaaagcacgaatataaagaatcgattaaaaaagcctatgcagtaaaaaaagcattacagttgagcaaagaagagactattttgagttagaggtgagcagagcatgatagtaatgattgataattatgattcatttacgtacaacctggtccagtatttaggtgagcttggagaagaattgatcgtgaaacggaatgatcaagtaaccattcaagaaattgaagaactcaagccagattttctcatgatttctccagggccatgcagtcctgctgaagcgggaattagtatggaggcaatcaagcactttgcgggaagtattccgatcttcggtgtatgcctagggcatcaatccattgcgcaagtctttgggggggatgtcgttcgtgctgagcgcttaatgcatggtaaaacgtcagagattgaacatgacggaaaaggtgtcttcactggactccaaaatccgcttgtcgcaacgagatatcattcattaattgtcaaaaatgaaacgctgccggagtgctttgacgcaacagccagcacaaaggatggcgagctcatggctattcgccataaagagctgccaattgaaagtgtacagtttcatcctgaatcgattatgacgtccttcggaaaagaaatgcttaaaaatttcattgaaacctatcgtaaaaaggggcatgaagtaaacgcatgatcatttatctgaacggtcagtatatagaggagaaagacgcgactctttctccttttgatcatggttttctatatggcatcggtgtattcgaaacatttaccagcctggcaggacaagtctttctgttagattggcaccttgaaaggctcaatcaatcattgcgtgacctttgcatcgaatccacaatagagaaaccatttgtactcgacatcattcataccttactaaataaaaacgaaatagccggtggtcatgcgagaattcgattcaatgtttctgcgggcaggggcaatggattttctgcagatccttatgaagagtctgtcgtgtttgtcatgatttctccattccggcctgaatctgttttagatgagaaacagggagtcattcttcaaacgaggagaaatacgccggaaggtccgaggcgcctcaagtctcaccattatatgaacaacctgcttgcaaaaagagaagtgggaaatgacccgaagttagaaggtatctttttaacaaaagaaaatgatgtggcagaaggcattacctccaatgtattttggcgaaaaggcgatgtgatttatacaccgtcacttgatacaggcattttaaatggggtcactcgtcgatattgtatcgaaacactccaagcgatggaggcttcactaaaagtagggcgatacccagtctcccatttgctatcagctgatgaggcatggatgaccaattctgttcaaggggttgtgcctttcagaagtataggggaaatctcctttccccaaaacagccggatcttctcaacgaaattgagagcacaatatacaaaagaacgtctagattataaagagtaggtggacacaatgacacaacaagtgataaagcagcctaaagtcatacaagccaagcaccacacccttagttatgaagaaaagacattggtcatgggcattttaaatgtcacacctgactctttttcagatggaggaaagtttaatcaagtggataaagcgctggctcatgcagcacagctgatagaggacggggcacatatcattgatattggcggagaatcgactcgcccaggagcggcatttgtctcagaacaagaagagctttcaagagtcattcccgtcattgaaaagatcacgaaagaattggatgtaccgatttccattgatacgtataaagcccatgtggcagatgaagcagtgaaagccggagcttccatcattaatgatgtatggggagcgaaggcagatcctcaaatggcgcatgtggcagcgaagcacaatgtgccgattattttaatgcacaatcggccagagcgaaattacacacatttgatttcagatatgatcgcagatttgaaagaaagtgttcagattgcgaaacaagccggtgtccgtgatgacatgatcatattagacccaggtgtagggtttgcgaaaaataaagaggacaacctgatggtcatgaatgagctcgaacatttttgtcaccttgggtatccactgctcttagctacatctcgaaaacgattcatcggagctgtcttagacctgccaccggaagaacgtactgaaggaacgggggccacagtctgtcttgggattcaaaaaggcagtgcgatggttcgtgtacatgatgtaaaagaaatcgcaagaatggcaaaaatgatggatgccatgctgaataagggaggcgcttatcatcgataaagtatatgtaaatggaatggaattttacggctaccatggcgtatttgcagaagaaaataaattaggacagcggttccgtgtggatttaacagcttcacttgatttaagtaaagccggacaaactgatgacctcaatcagaccatcaattatgcggagctctaccaaatctgcaaaagcattgtagagggtgaaccagtcaacctcgttgaaacactgacagaaagaattgcgagccaagtgctaaaggattttccgacagttcaggaatgtacagtgaaggtaatcaaaccagatccgccaattccaggacactatcagtccgttgccattgaaatgacgagatcgcgcgcatgaacaataccgcatacattgctttaggttcgaacatagggaaaaaggaaatctatttaaaagaagctgtgaaaaaactgcacgaacatccagatgttcaagtagaatcgatctcatctatatatgaaacaacacctgtaggttacgaaaaccaagatgactttttaaatatggctgtgaaaatttccacctcgcttcgtccaaatgaattactggcacttactcagaaaatcgagcaagagttaggcagaacaagagaagtgagatggggaccgcgaacggctgaccttgacattttactttataatcgtgaaaatattgaaacagaacagcttgtagtgccgcatcctagaatgtacgaacgtttattcgttctcgttccgatgagtgagatttgcccagaaatcggcgaagtacaaataaatgccgtaacagaccaagaaggtgtaagcatatggaaaaagacatgtggggtagaagaattcgtgcataccgaaagctaaaagggtatactcaggaagggttcgcgaaaagactgggcatctctgtctctgtcttaggagaaattgagcgtggcaatcgattaccaacaaaccaattggttggtcaaatagcagatgctttaaatataacggtggaagaactttcgccaattcttgaagaaggaaggaggggaaatgatgtttaaaatcggagatatcgacattaaaaacaaagtggtgctcgcgcctatggctggtgtgtgcaactctgccttcagactgacagtgaaagagtttggagcaggtttagtctgcgctgaaatggtcagtgataaggcgatcctgatcaacaatgcaagaacaatgggtatgctatacattgatgaacgggaaaagcctttgagccttcagatatttggaggagaaaaagacactctcgttgaagcggcaaagtttgtagaccagaataccacagcggacattattgatatcaacatgggctgtcctgtgccgaagattacgaaatgtgatgcaggagcgaaatggctgcttgatccaaacaagatttatgaaatggtctctgctgttgtagatgctgtagataaacctgttacggtgaaaatgagaatgggctgggacgaagatcatatcttcgctatcgacaatgcccgtgctgttgaacgagcaggtggacaagcggttgcgcttcacggacggacacgtgtgcagatgtacgaaggaacagcgaattgggatattataaaagaggtcaaacaatctgtttccattccagtcatcggcaatggagatgtcaaaacccctcaggatgcaaaacgtatgcttgatgaaacgggtgcagatgctgtcatgatcggaagagccgcactaggaaacccatggatgatctaccgaacggttcattatttagaaacgggtgaattgaaagaagagccaaacgtacgtgagaagatgtcagtgtgcaagcttcacttagacagactcattgatctaaaaggcgagcatgtggctgtcagagaaatgagaaagcacgcagcatggtacttaaaaggtgtccgaggcaatgcggacgtgagaaatcaaatcaatcagagtgaaacgagagcggagcttgtacaagttcttgataactttacgatcgaagccgaggcaaaagagcttcaaagtataaaagcaggataagactatctttctttttgtagctcactgctagtgcatgtactggcagtttttctgcttttctctgcaaaatacattaatggagtgatataaatgagtaatgaagggcttaataacgaagaattaaatgaccaattccaggtcagacgtgacaaaatgaataaaatgagagaagagggtatcgatccattcggtgaacgatatgaccgttctcatcaatctgcccaaattattgctgaatacgatgagttttctaaagaagacttagaagaaaagtctgcccaagtgacaatcgctggacgtatgatgactaagcgcggaaaagggaaagctggctttgcgcatatacaagatttagaaggacaaattcaaatctacgttcgtaaagatagtgtaggagaagaagcttacgaattattcaaaagctcagacctaggcgatattatcggtgtaacaggaacagtatttaaaacgaatgtaggagaactttctattaaagcgactagctttgaggttctgacaaaagcacttcgcccgcttcctgataaatatcatggacttaaagatgttgaacaacgttatcgtcagcgttaccttgatctgattgtaaatccagaaagtaagcagacgttcatcatgcgaagcaagatcatccaatctatgagaagatacttagattctaaaggatacctagaagttgaaacaccaacaatgcacagcatccctggtggtgcatcagcacgtcctttcattactcatcataatgcactggatatgccgctttatatgcgtattgcgattgaactgcacttaaaacgcctcattgtcggtggcctagagaaagtatacgagattggccgtgtattccgtaacgaaggtgtatcaactcgccataacccagaattcactatgatcgagctttacgaagcttacgcagattataaagacatcatgaacctaaccgaaaacctgattgctcatattgccgaagaggtactaggaacaaccacgattcaatatggagaagatgaaattgacctcaagcctgaatggaagagactccatatggttgaagcggtcaaagaagcaactggtgtagacttctggcaggagatgtccgtagaagaagcgcaacagcatgcagctgatcacggaattgaaattacgaaaaacatgacagtaggtcatatcatcaatgagttcttcgagcaaaaagttgaggaaactttggtacagcctacatttatttacggacacccagtggagatttctccattagctaagaaaaatcctgaagaccctcgcttcacagatcgctttgagctatttatcgtacgccgtgaacatgctaatgcattcacagagctaaatgatccaatcgatcaaagagaacgtttcgaagctcaattaaaagaacgtgaagaaggaaatgacgaagcgcatctaatggatgatgattttgttgaagcattagaatatggtatgcctccaacaggcggacttggaatcggtatcgaccggataatcatgctattaacaaattctccatcaatcagagatgtactgcttttcccacaaatgagaaaccgctaatacgtcaattaaagcgccattataactatggcgctttttatttttcataaaatgaaactttttttaaaaaaactattgcaaggaaagaatcaaggtggtatattattattcgttgccgcaaaacagcagcgaggttaaaaaaagaaattgaaaaacttcttgactttaaccgacacaaaatgttaagatattaaagtcgcttaagagcgataacgaaaatgatctttgaaaactaaacaagacaaaacgtacctgttaattcgagtttttataaaaaaatcctatgaaatatcataggtagtcagtcaaacgatgacgaaaaacaaaatccagttgcaccagtaactccagtaggaccggtatctccagttgcgccagtggctccagttacaccagtggctccagtaggaccggtatcaccagttacaccagtggcaccagtaggtccggtatcaccagttgcgccagtagctccggtatcaccagttacaccagtaactccagtaggaccggtatctccagttgcgccagtggcaccagtaggtccggtatcaccggttgcaccagtggcaccagtaggtcccgttggacctgtatcaccagttacaccagtggctccagtaggaccggtatctccagttacaccagtggcaccagtaggtccggtatctccggttacaccagtaactccagtaggtcccgttggacctgtatcaccagttgcaccagtggctccagtaggaccggtatctccagttgccccagttgcgccagtggcaccagtaggaccggtatctccggttacaccagtatctccagtagcaccagtaactccagtaggacctgtatcaccagttgccccagtatcaccagtaggaccagtatctccagctgcaccagtggctccagtaggacctctttttacaatcttattatttgtttttttccgtccttttgctttagcacaagtgctgtgatgtttaacaacttttttctttttacattctcgtttaagaagagggcaatcatcaagtagaggtctatcgtgacgagattttctgtagtgaggttgccaatcatgcttttttccgcaaaagggacatttgttatcgtactgattatacaaattccccatctcctaaaagttaatattttattctatgtagaaatttaaaaagcggaattgagctaaatgatattttttagttcgaagttcatcgaatcaaatgatttaaaaattaaatcgttttatgttatggtgttgaaagtatgaaactagtatgatttttgacagaaatggggacatcatttatgagtcaatcagttttacaacacgcagcatattccgtgttaaatttatcctctgtaacagaaggtggcacaatcaaagagtcatttgaacatagtatggatttagcaaaaaaagctgagaagtggggctaccatagatattggcttgcggagcaccataatatggaaggggttgcgagctcagcaacgtctgtcttaattggacatattgctggagggactgaaaagatccgggttggttctggggggattatgcttccaaaccattcttcactcgtcattgcagaacaatttggaacactggagactttgtatccagggagaattgatttaggtctaggtagggcaccaggaacagatcagttaacagcaagggcacttagacgtaatcttcataatggggaggatttccctgaacagcttgaagaacttcggcaatatttcaaaccgaccggtcatgtcaaaaaacatgtaagagctgttccgggagaggggctagatattccgatttggcttcttggttcaagtggttttagtgcaaggcttgcaggagaacttgggctgccatttgcctttgcggcacatttctcacctaaaaataccattcctgcattagaattatacagacagtcatttcaaccttcagatgtgttaaaagaaccttatgcgatggttggtgtgacggtttttgctgctgatcatacagagagagctgagtatttggcgacgtctcattatcagcgatttttgagcctcattcgtaatacaccaggaaaacttaaagcccctgttgaaaatatggatgggctgtggagtccatatgagaaggcaatggtggacgaacaattaagttcgacgatgatcggggataaacaaaaggtgaaaaaagagttagcagcctttattgaggcgactcaagcagatgaagtcatgattaattctgatatgtttgaccatcaagaaagaatgcgttcttatgaaatcattgcagagatatttcaggaggaacaagaaaaataagaatttaaaaaagaactgcaaagagcagttcttttttatttatgctttagtaaacacgcgaaatggttgtcctactggcagtactgtacgaccgaaatgtgtattgagtacaacagctgcagaaccataaaatgaaagaagagaaataattaattctgcaataccagcaatcgtatgagttacatcatacatcacaccaaacgagctaagggaaaggccgatgaataagaaatcaataaagacgaaaatcaaaaacaatactttatgtgtttccattgcaccgatcgtcataaataagctgaaaatcaaataaccaataaaagcaaaacctagttgttttgggtccgcagcttccgcaagcgttttcccaaaaacgccagcttgaatgatccaagtcgttccaacgcccatccaaaaaagaccgaatgcgccgaaggcagtggctccaaaaatattatgatgctttgaatcttgtatggacgcgatgagttgcgcgattcctccaaggaagatagcccaaggtaaaataagggatgtgccatctgtgattcctagtttttgtgaagacgcaacaagcgtcaccattgctaaaccaaacaaaccaagtggtgttgggtctgcaattgataatcgaattgcttgaacattttgtttttccataatgacctcctacaatttgcacttacaaaagatactcgaattcgatagaaacgtcaagctcttttttagtagacacttgcaacgtcttccaaataaatctatatttaatacataatacatgtgatagaaaaagagggattagaatgagtaaaggcttagctggaaaaaccattgccatatgcggcacaagaaaaacagaagaaatgagtacacttgttgaaaagcaaggaggacaagctgttattcgttctcttcagggcactgtatttttagccaaagaggagttaaagccaggcatagaaacctttgtaaagaagggagctgactgggtgattttaacaacgggtattggtacagatacattaattgaaagtgcagaagaattgcaacttggagaagaatttatgaataatttatcaaatgctcatattgcttcaagaggatacaaaacgttcgcggctctaaaaaaacacggaattcagcccgatgtgtctgatgaagacggaaccgttcgtgaccttatttcaaagttagaagacaaagagctgcaaggtaaacgtgtcatggtgcagcttcacggcgaaaatgcaccagctctcatcgactttttacataagaagggagcagacgttttgcagctcatgccgtatcagcacacgccccctgaaccagaggcggctgacactttgcttcatgaaatgaaagaagggaaggtccatgccgtctgctttacaactgctgttcaggttcaatcctttttcaaactagcagaagaatggggcaaaaaagaagagctgcaacatctattcgagcagcatgtattagctgttgctgtcggaaaagtcacagctgaagctttaaaagaagagggagtcagccgaattcttgcccctgaatttgagagaatgggtgcaatgattatagaattatctcagtatatgaaaaaacaatcgacacactcatagaaaaaacgcctttcacatgatgagtgaaaggcgttttcgttagattgtccgttttcgattcgtgcgaatttttttcaaaacgaaatatagcacaatcaggacaatggcaatcgccataattggtgttgtatacgtatgagcgacactttgaatgtggccccattttgttccaagttgcataccgaggtaaataaaaaggatagaccaagggatggcggctaatccggtcaggagaacaaatttgagaaatggcatctttgcaataccagctggaatcgagatcgcatggcgcacgactgggataaaccgggctgtaaatacgacgcctgttccatatcggtcaaaccagcgttctgccgtggcaatatgatgctcatggatgaataaatacttcccatactttgttaaaaaaggtctgccgccgtaaaggccgatccagtaaataaagcactgggccagcgttcctccaatgaccccagcgatgacggctccaacaaaaccaatgcttcctgttgacaccatatatccgccgtaggcaagtacaatttcactcggaataatttcaatcatcagtccaagtgcaacacctgcgtaaccaaggcttgtcagccaggttaaaatttcattaaacaaggttcccattcatttcactctgcctttaaatacgaattttcttcaagcatccttataagagcctatgcttgttttgcttctctcatgagtatgctttgcatatatgctagcatggctggccgcatatcatgacgtatcaatccgatttcagccgttgccttaaatgaaccgagcttatcaccaacgtcaaatcttatcccatctagttgttttgcataaatgggtgattcatgtgcaatgattttcagcgcatctgtcagctggatttcgtttccggcacctctctcgattcctagtaatataggtgttaaaaggtccctgcccattatggctaaatcggaaggagcatcatgaatagctggcttttccactaagtctgtgacttcaaacactagaccgtctattctagctggtcttatcataccatatttgctgacatctagacgatccacttgctggacgccaatgacctctatttgtttgtcttcaaagacttccatgagctgagagagtgcgggtctttctgacaccataacatcatcacctaaaagaaccgcaaaaggatcgttgccagtaaaatgacgtgcacataataccgcatgcccaagacgaagagattgaatattggccatatccgcaatatgtttgatttcagccagctgttctttttccctttttcgagcaaatgatgttctagttcaatcgaacggtcaaagtgatcttcatgccaagaaaggggccaatcgctttacttaagaatcatgagaaacctgctagatgcatgacatataagacaatataggtgagaagagacgctgctccgttgactgcggctcattcgcacctgtcagttttcttttttacttggaacgtccaatttcgcactgtgcgagaaaagaggggacaaagcaggcagttaaaaaagaagaacagaaagtcaatcagcgtattgcttgcgcctacaatgaaaaatgcagtataggaccgaaagtttttctttgtcatgtgaaggatcatcacctcgtgatataatttgtaagatgaaacgaacggtggtgcacattcatgtatttaacaattggagaaacagctgaatacctagaagtatctgaagcatatgttgaaaaattaattcggcaaaaaaagattcgctacgtatttgacggggaatcatatctcatttatcaagggcagtttcaaacacatatgaaacagctagaacaatataaagagctcattcaagacatcttaaatgaaccgattcctgaggacccggacgtaaaagatgaagattaaaaaaagactgtatgagaagggagagccttttcatacagtcttttttattggctgacaccagtttggacaatgttcatatgacaattcacttgaacatctgcatcagggtagagtttttgccatttttctggtgtcatggctttatctttagagcgatatctcaaaccgagtccaagcggatcaattttttgatttttaaaggattgaacaagttctcttccttgctgagctacacgctcctcaacttctttttcgacatgctttaaaatagaaggcgtatcgatttttttcgatttcatgaattcttttaattcacctttcagtttgatatcaatggtgatatgaggcttttttgtaaggttttctgttggtttcatatgataagacacatgtgatttaatattttcaatgacgacatgtgttttctttttgtcattaaatcgaaactcataaatcccgtttatatgattttcaatcatcgctttaaacgtaaacgtatcttcccctggaatatgcccaaccattttttcttgatcaaaaagggcgacacctgacactttaatagagttgcttgtatttttaatgtaagggaggtaagcatcaacgccttttgccatcatctgattcataaaaatatgctgattggtgacaggttgattgccgtttcgcatgttttgggcgagcaaatctgaaagatatacacctatatttaagttggtttgattcatttttgtatgcaataaatcttcaacttctccgtctactatggcaaatacttgccttgacccaatgatcggatcacgatagatgtaattcatcaaatcaatcatacccacttctttcgccagcttttcacttattaaaatcacgagtacttgtcccatgacaacggggaaaggcgatttttctgaaacaagaaactgaatattactaatggtatttgacttagcacttacaatttgatagcttccttgctcttcgcttttaaaaacagggaaaacaaagaagcccttcatttctccatcttccaataagtcaaatcccgccgcctgcgagatacttaattcatctaagagacgaggctctgcacagctcgttaaaaaaagactaaataacatgagacacatcagaatagaatgtttcatgctcgttttttcacccacctttttttcagcagcagcccaatgatcatacatccaatcaatccatagatgaggatgtacccgctatattccacccatttattaaatgtctcaaaagaggtagctccgataaaaaatgaaaacatgccgagaatgagaaggctgagaacaattaacgtgatgcgctggctcgtctgaaacacttgttttgccattctgctggcggcccataatggaatggcgatatttggaacgatgagcaaaagccatagcgacacttcaataaattcaaagcgctggataaacggaagtttgacaatgctggtaaatgtcaatgtcggccatttcgttagtttgagctgagcacttgagtagtacgctatagaaacgagaaatacaagcaaattgaggcatgtggtcagcaatgcccccatatgtgcaaatttttgcgacgtttgtgcttttttaataaagggataatagacaagcagtgttccaaaaccaaacatggataaagaggcatctttgacccccaccatgagttgtgaaaatgaatgatcaaacattgggaacataaaccggatgtgactatatttcatgacataaaagcagataaaggtcatccagtacgttaggataatactaaagaatgcccaaccagcgattgttctaaatccgcccgtatgaatgtaatagacaaggatgagaagcactgatgcaaataagaggccgggaatttctttaaacagccaaacatggatcacatccatataatgaataagcacaatcaaagacaatgaagaaaaatacaaaatgtagagaatgttgatgaattgtccgagccatttaccaaacacagattgcgtaatgtcactaaattcgtcagtaggtgcttttttaaacaaaaagtaaataaggaaaatcattaaattgacacttgcaccagcaattaaaatggcaatccacccatcattattaatcgtccggacaagattcgtctggaaatttaaaataccaacacctacttgattggcattgacaagaaaaaatacaaaaaaaggggatacttgaaatttttcttttacagaagaagaactcatgccttcacttccttattcataaaaatcatttttccccttgcggccttgcttcggcttttggtggtgtatcgtttcatttggcgggcgtaagttctctgggcgtttattcaaaaatcggagctgaggtcgaatcaaactgccctttaaatcggccaatcgaagtggaaagataggttctaagtaaggacgaccaatagacgttaatttcattaagtgggtaagaagaaaagctcccatgagcgcaattccgagcgctccccacgcttgtgcggcaaaaagaaatgggaagcgtaagagacgaatggtcgtccccattttataaatcggtgtgacaaaagaggcaagagctgataatgcgacaataataagcagaatattacttgttaatcccgctgcaactgctgcctgtccgatcacaatacctccaacaatcccgagtgtctgtccgacttttgctggaaggcgagacccggcttccctaagcagctcaatggatatctctaaaaataatgcctcaataattggcggaaagggaacgagatagcgtgatgctacaatcgtttctaataagtccttaggaatcagttcataatgaaacgttaaaatggcaacatacaagggggttgcaaaaatagaaaatatcacagcaaaaatgcgtaacagtcgaaaggaggatgctgcgatccaagacatgttatagtcttccattgtagaaaaatactcgagtaatattgtaggtgcaagcagggtatgaggcgaaccgtcaaccataatggctatttttccttctgttaaacctgaagaaaccctgtctggcctttctgtatttaaaaataatggaaagattgtattggacacatcataaagcatttgcgcaagataatttgaatctagaatttggtcataatcaacatctttaatccgctgaagaacggtttcaatgttctgcgggttggcgatatcctctatgtatacaacggctactttcgtttgagaaagggttcccactgtgtgttcaactactttaaggccaggggttggcagtctgcgtctgagcaagtttaagtttgtatccagcccttccacaaaggcttcctgcgcactgataatcccgaattcaatctcaggttgactcacttgtctacctttcttttcttcaatcggtaaaaggagcgttttgccccagtctgtctcaattcgaacagcaatactgccacgatgaagagcttcttccactttttgaaggtcacttgtaatcacagcttgttcaattgggatgtgttctttcagctcttcaagagtgggtgtcaaatgcaattgttgaataaaaggcaagatttgttcatgaagtaaattgccattaattaaaggtcgaaaaaaagaaattcgataaagaaaacctccggagcttgataattcattaataaaatcagaggaacgagataatgcttcaaatactgaattcgggtctttctgatgaggtttatttttcttcagcacttgaaccatctcctttcgcgatttgcctctattatccaaccaatcgtctgaagatatgcataaaaaaagcgttcagcttcatgagctggacgctttttttccatattgaacggcttctaataaaaagtcagccagatgaattgctctcatgctgggcgtatgtcctgcctttttgacgcctgctgccatttgtaattgacaacctggattcgacgtaacaatggcagccgctgctgtgtggttggcttctgccattttatgatctaaaatctgcatcgacatatcgggctgcaagatattgtagattcctgctgatccacagcagcggccggcatctttcatttccttaaacgttactccttgaatggctttcatgagcaccctcggcgcttgttgtacattcataccatttcgtaaatgacaggaatcttgataggtgatcacttgcgctggcagcgcaagtggcatgctgcggtgaaactccagctccacaagaatgcttgatatatcggttattttctgtgagaaggctttacttcttttttggaaatctagatcatcctgaagcaaatggccgtaatcagttaaaaaggcaccacagccgcccgcattcatgataatagcatcggcatctgtatcctcgaatgcttcaatattccgcttggctaactgttttgcttggtctttttctccgctatgaccgtgaagcgctccgcagcatgtttgtatagcaggaacgacgacatcacagcctgctagctgcaaaagatgaatggtcgcttcgtttgtgcttgagaaaaccgtatccattaaacagccagtaaaaaacgccacccgtttttttgtcttaccaatggctttatattcattcaaacgttttttcttttgaggcggcacctttggaagcgcttgttccatcagctgtaaatgggagggaagcaccttcagtatgcgcgtcttgcgggcagccgtttgcagaccagatgtttgataaaatcgaagaaagctagcagcttgccgcatacgactttgtgaagggaagagacctttaaacacaactcgtctcatcaatttgacaggaagcgattgttttttgtgctgttgaataatgtctcttgcatcttctagcagctgtccatacttgacgccagaaggacaaacaggttcacatgcacggcagccgagacaaagattaagtgaatgttcaacatcttcatctggttcaatgacgccatctcttacagctttcattaatgcaattcggccccggggagagtgcgtttcttgttgtccagattcaatataggtagggcaggaagggaggcagaagccgcagcgcatgcaattaagcagctccttttcatccatttgctcctgaaactgctgctggatctctttttgcttagaagaagaactcatgagaccaccacccgctttcttgaggcttttccaaacactttatctgggttcatgatatttgccgggtcaagcgcctgtttgatcgctttcattgcagcgattccttcttttttgaccttcagctccaaataaggggctttcatgagaccaacgccatgttcgcctgtgatggtgccgccgagtgcaacggctttttcaaaaatggcctgaaaggcagcttctacacgtgtcatttcttctacatttcttgcatctgtagcacaagtggggtgtaaattcccatcacctgcatgaccaaaggtacaaatgttcacctcgtattctcgggcaatgtcttcaattgcacgaaccatattggcaatttcagaccggggaacggtcgcatcttctaaaatcgttgtagggcttaatcgagcgagagcagataaagcagagcgtctcgctgttaagagcgcacttgcctcatcttctgaatgtgcgatcttcacgcttttagccccgtgctgttcacaaacttctgctatcttttggatatcacgagaaacagcttcggggttgccgtcctgttcaattaataacacggcttgaacgtcagtaggcaggccaatgtttgcaaaatcttcaacgacttcaagggtcggctgatccataaattctaatgtggcaggaatgatacgctcagcaatgatggccgagacagaagtcgcagcttcttccaggctttcgtataaacaaagcatcgtttgtttcgtttctggaagcggcaggagcttcagcaccgcttctgtgacaatcccgagcgttccttctgaaccaacaaacaatcgagtcatatcatatccagcgacatcctttgcaagctttccgcctgttttgataatgtcaccatttggcagaaccacttcaagcccaaggacataatctcttgtcactccatactttaacccccgcaggccccctgagttttcgttaatattgccgcctaatgtggaaattttcatagagcttgggtcaggcgggtagaagagacctttttcctctacttgatgaatgaactcctgcgtaatcaagcccggctgcaccgttgcggttagattttcttcgtctatttctaaaagttggttcattctagtaaagagaatcaccaacccgccttgggtaggacatgttcctgcacaaagattcgtccctgaacctcttgggacgatcggcaccttgtgagtggcgcagagtttaacaatttgctgcacttcctccgccgtgcgaggtgacacgatggcatctggcatctgctgaaaatttggtgtcgcatcataagaataggcaagacgatctgccttgctgtcttggacatacgacgccccaacaatctcttttaattgatttgaaaattctgaatccagcatatacaatcactcccgctcatttaacgtctcgtttctaccagtataaaaaaagaaccgtcacatgcctatggacgattctacaaaatatcaggctgttttatagttttttttgtatcatgatctaaaaggagcaaggccaaataaaaaagcatcgcatcttgcatgcgctttggatcaagtgtcgttaaatcctgaatccgttttaatctgtaatgaagtgtattaatatggacatgcatggcttccgctgtatgtttcaaagagtaatctgaagctatgagtacccgcaatgttttcactagttcaggataggggaaaagggatgtaatcgttcgatcaagaaacgcatcttttgtttcctgactgatttcctccataaaaagttcaagtgtcaaatcttcatcaaacacaatcggtgtttcagcatgcgccaattttaaagcgcgaaaagcttgatgaaaagactgcttcatgacatgagaagctgctggttttcccgcgccaatgaaaaccctcgatggtgaaagcgctgcgagcgcagcatggatatggaacaggcgcttgtgccatgtagcacgaccatctggtgtggtttgcagcatgagcaaaaaacgggcatgcccccagcgcacaataatttcctgattggtcaggtgcaatttgtccttcatcagtttgtattgatcctgcttcataaacgattcatcttggcaatcaatgagtacaaccacacgctgcttgttgacatcaagaccaagctgctttgccttctcggtcatatcaacagctgtctctggcagatgaagccagtcgaacacaaaggcttcaagctgcctttcatctgtttccgtttcttgaaaaaattcatgctcttgaatgagcagctccgtcattttacgtaaaatgtcgccaaaaggggagacatgccttggatcgcctgtcattccaatcacaccaatgacttcttgcttaaaataaataggcagattgataccggctttaacgcctttcatatgcagcacatcatcctttgtgagaattcgtttctgcccttctaaggacgtgacatatgcgccttcatgaaattgaccaatgcgtgctggatctgttgcagcaataatggtaccgtttgtttgtgtgatgatgatttcttccgtcagtacctttttgacctcatctacgattttttctgccagtgtcattgtgagcaaaacggtcccctccgagatgtttctttttacactatcataccatcatatgctcaggcatatctttcttttcatatgttatgctaaaataaacaacgcataggaagtagatgaaaggagacacagtcatgtcactgcaaaatcgattacaagatttattgaaagaagggcaggcgctcacagactttgaatataacgaagccgcacgtcaaaattggccgctagaaggggcaaaaatgacagaagaagcacgctttgctgatgtttatatagaacgagtggacaaggaatcggaggaaatgattcaaacggaaaaagtgtcctttttgaatacccctcttacatatgtaaaaaaacaacaaaaagaattcatttatattgagtcgaagtggtttgaagtggtggaagtcgatggactggccattgaatgggatgaagtattccaaacgtatacagtattattcggattcaaacgtcagaaaaaagagacaggacagctaaaagacatattctctgccttacatggtgctcagctccaatttaatggtcaagacggcttatttgatgtgaatctgccccttcttgagcttgatgacatcgaggaagatacgcctcttattggtgtcatcacgtcaatgtaccgctttttattccgattgctgatgcagcttgaaaagaatgaatcaaaaaacggctcaaatccctgagccgttttttagagcaatccttttatgaattgagcctcacccatcccgaagctccaatcggcgtctccattttccacaatggagatcatcacatccgttttggcaaccccgcattctttttctacacgttctgcgatttgtgcataaaacttttccttttgctcttccgttcgctgtttactgacaacactaatgacaaccagatcctttgttctcgggtaaccaagcccagtgtcttcaatgatcatctcttcagcgcggtgttgatgtacaatttgatagcgatctcgttcaggtacaccaaaggcatccaccattgcgtcatggcaagtgtctagcagtttttttaaatcctctttagaacggccttctatcaggtcaaatcgtaacaatggcatcacgtctacctcccaatatgtgttaaatgtacggttataatgtagccaacacttcgctgtttcactcgtttgtgcataagaaaaaagccaaaacactgcggtttggctttttcgctttggactaaggcgtgacaaactttacatcatgctcttttccatattgaaggtaatcttcatttggctgctcgttggtcaccacgatgtcgatatcttttaagtcacaaaacgtggtcaaggcataatgatcaaacttactatcatcaactaataagaaggttttggcgtttttttcaacgagtgtctttttaatatcagtctcaagcggggaggaattcgtcacgccgtgatcaatggataaacctgttgacgcaataaatgctttattgacattgtatgcttttagacgctcaacactttgataaccaacgaaagaatttgtttttcgctctagtataccgccggtcgaaaagatggtgaggtgttcataaggcatagcctgtgtaatgaaatccacgttatttgtcacaacggtgatctgtttctccgtcaaataaggaagcatctccagcgtcgttgtaccagaatcaacaaaaatcatatcaccatgttcaacaaatgcggcggcagtctgtccgatgagttgttttttactcagctgacgagtctttcgctcctgatacaccactaatgtggagtgattcacagccacaccgccatagactttctttagcacgccggattctaccaatgcttgtacatctcggcgtattgtgttttttgagacgccaaaatgcgccacaagctcatcaagagaggcagattcccggtcaaatacatactcttttatttgctgaatacgttttgtttttatcatgctataatctccaatcaatacgaatatgctgattttattataacaataattccacgtaaaagatgtcacggatcaacatgggagaattgaatgatctttttctcttatcttttctcatttttcataagagcgtatgatagagaaaagaggacagaaaggattttcacttctatgaatcagcacaacatacagttttcaaagcttgcaaattttagagagatagggggactccaaacaaccgatcagatggtgattaaacaaggaatgttgtatcgatctgccgatttatcccgtctcactaaacaagacatattgaccttctcgacacttggaattcaaacgatttgtgacctgcgtacaagctcagaaagaagatcacacccgccaaagatcatggaacatgacaaaattgttcatatccctatgcagcctgacagcatgatgcctagcaaatgggccatgtttcgaatgctggtagcagaaggaaagtctctatcctttacgccgatcatgaaagatttatatcaaagcatgctcaatgagcgaaaagaagaaattcagcaattgtttacattactgtccgatgaaaaaaattatccgcttatgcttcactgtacaagcggaaaggaccgcacaggctttttatctgctcttatacaattagcagcaggtgtgccggtgtataccgttttaaatgaatacatgcgttccaacgaaggcgtgcgaatactagtgaaaaggcaagaacgatttgttcgcatgatgagtttataccgggtgtcaaaagaacaagttcaaccgctgcttggtgtgcagcaagattatcttgaggatgtactaaaagagatgatagatacatacggaagtgcagagcagtatttactagaagcctgcggggttcccaaagctcagctgatagaaatgaaaaacatcttgcttacaccatctgctggcattccatcacaaaacgcagaataaacttgatatgaggtgatgcaaaacatgttgaaaaagatgagtatgacagttctgacattggtttttatgtgtgtattcttattgattccttctagcagtctagctcgttcaatgccaaaagggaagcttgagagcacaagagagatgcgtgccgtgtgggtcgcatcagtgtataacctagattggccttcaaagaaagggctgtccgccgaagagcagaagcaagagttcattcaactgttagacgagatcaaggcgatgaatatgaatgccatcatcatgcaaattaaaccaacagcagatgccttttatccgtcgaaattcgggccttggtctgaatatttgactggtacgcaagggaaagaccctgggtatgacccgcttgaatttatggtagaagaagcacataaacgaggccttgaatttcatgcttggtttaacccttatcgaatcacaatgaatcataccgatctcaaccgattatcagccgatcatcctgcaagagcgcacccagattggacgatcgcctacggaaatcagctgtactttaatccaggcattcctgatgctcaggacttcattgttgacggcattgaggaagtggtgaaaaactacgatattgatgcggtgcatatggatgattatttttacccaaataaaatagcgggtgtgccatttccagatcaagaaacgtatgaaacatatgggaaaaaagcatttacacatatagaagattggcgaagagataatgtgaatcaattagtgaagcagattaatgacaccattaagaaagaaaagccatatgtgaaatttggtattagtccattcggggtatggcgtaatatcaaagacgacccgactggttcgagtacaacagcagggatgaccaattatgatgatttatatgctgatacaagagagtggatacagcagcaccatattgattatatcaccccgcaaatttattggagcatcggctttcagcccgctgcctatgatgtactgacgaaatggtggtcaaatgaggtgaaggggcagcctgttcacttatacattggtcaagcgacttataaaatcaatcaaaacagtgatcctgcttggtctgatcccgaagagtatttccgccagatcaagctgaacaggcagtcacagctcgtccagggaagcatgcattttagtctgaaggatatcaatcgaaatcccttgaatgtaaagaaacgattaatagaagaaacctatagcaaaccagccctcattccagagatgccatggcttcatcaaaaggctcctaaaaaaccaatcatccaatctgtgaaaaagacagagggtggcgcagttttacagattcaaaatgaccggagctctgccgcatcctattatgcagtctatcgattgtcaaataaagggacgtatgaatttgtgcaagcggccgtaaaagaaacaggctcctttacacatgtcaaagacctttcagcaaatcaaaagaagagctatacttacaaagtgacggctctcaatcgtcttcaccatgaaagtaagccttctacaaaaacaataaaataacatagtaaagcataaatggggattttcctcgatttatgcttttttgctttctctatttttctactattcttattttaattttctgaattcaatcaagcttggcatgaagcagctacttgattaataaatatgatagaaaagcgccaaagggggaagcacaatggattttgaattaacgaaagagcagcaaatgatccgtcagatggtcaaagaattcgcaaaaacagaaattgcaccacacgctcaaacgattgatgaacaggcgatttttccagagaaaacatttcagaaaatgggggagctcggttttatgggtataccctttccagagaaatatggaggatcgggaggagatacgatctcgtatgcactagcagtcgaggaaattggaaagcagtgtgcgagtacagggcttagttatgccgcagcggtttccttaggcgcaagtcccctttattacttcggtacggaagagcaaaagatggaccatcttgttccgttagcttctggaacagcactcggttccttcggattaacagagccaaacgccggatcagatgcaaaaggaacaaaaacaaaagccatcaaagacggacaagaatatgtgatcagcggggagaagtgctggatcacaaatgccaattttgccagaacaattattgtcaccgctgtgacggatcatgatgaaaacggacgtccgatcatctccgcttttattgtagagaaagggcaaaagggactttcaattacaaacccatatgacaaaatgggggttcgcggttcagatacggctgagatcatattagacgaagtgcgtgtaccggctcatcacatattaggagataagtcgaaaggattcaagcaatttttatatacattggacggcggacgaatttccattgctgccttatctgtcggaatcgcgcaagctgcacttgatgcttcactttcctatgcaaaagaaagaaagcaatttgggcagacgctctcatccttccaggccattcagtttaagctggcggatatggcgatgcaaatagagcttgcaagacaaatggtctggaaagctgcttggctgaaagatcaaggcaaaccatttacaaaagaagcggcctatgccaaactttttgcttcagaaatggcgactaaagcaagtcttgatgcggtccaaattcatggcggaacaggctatatgaaagaatgcggtgttgaacggctggtgagagatgccaagctgatggaaatcggagaaggaacctctgaaattcagcgtctcgtgatcgcaagacagctgttagcgtaataccttaatgaaaacgcttactattcatgagggaggaaagcaatgatgtcgatttacccgcaaacgatcggctccctattaagagagaaaaaagaacagcatccagcacatgaagccattgtttacccagaacgttctttacgttattcatatgaagcgttttatcacgaggtcaaggaaacaggtaaaggtctcatggcattagggattcaaaagggagatcatatcgccatcatggcaccaaatgtacctgaatggctcattctgcaattcgcctgcgcctccattggtgctgttcttgtcaccgtgaataccaattttcaatcacaggaactctcatatttactcaagcattctgacagtaaaatgttgtttattgttgacggatttaaagaaacgtcctatgtcaacatgcttgaagagctgattccagagcttcaaactgctcatcaagatgtaatcacctcctcatcattcccttatttgaaaagctgcgtctatattggtcagcatgtcccaaccggtatgcgcagctgggatagtatacaaattgcagcgaaaagaaccgaggatcatgagtgggagaagcgaatggatgagctcacgcctgatgacgtcattaatatgcaatatacctcaggcacaacaggctatccaaaaggagtgatgctcagtcatacgaatattgtctgtaatgccggtcaaatcgcagattgtatgaaattaacagagcaagaccgtatgtgtatccctgtgccattctttcattgctttggctccgttcttggtgtacttgcttgtctcacaaaagggggaacgatcatcccacttgaatcttttcatccagaacgagttctgcaaacagttgaaacagaaaaatgcactgtccttcacggtgtgccgaccatgttcatcgcagagctcgatcatccaaatttccactcttatgatctgtctacattacgaacgggaattatggccggttcactctgcccgtcccatgtaatgaaagcagtgattgaaaaaatgggacttagagaacttacaattgcctatggtcagaccgaaagctcacctgtcattacccaaacaagaaccgatgattcgtttgaacgacgagttcaaacggtcggacgtgcgcttcctcacattgaagtaaaaatcaccttgccaggaacgtcaaaagaagtgccaagaggacagcaaggggagctttgcacaagaggttaccatgtcatgaaaggctattataaaaacgaagaagcaacaaatgaagtcattgatgaggacggatggcttcatacaggggatttagctgagatggatcacgacggctatgtaaaaatcacaggccggctcaaagatatgatcatcagaggcggagagaatgtgtacccaaaagagattgaggatgtcctatacactcaccctgccattcttgacgcacaggtcgttggtattcctgacgagacatatggcgaggaagcagccgcattcattcggctgaaacaagggaagtcgatctcaattgagacattaacgagctattgtcagtcgcaaatggcacgctacaaaatcccgaaatattttttcattacagatgagtacccaatgactgcctcaggcaaaattcagaaatttcgcttgaaagagcaggcgcttgatctaataaaggagtgaaggcagcgatgtttgaacaagtattggtcgccaatcgaggcgaaattgcccgtagaattattcggacatgtaaacgactcggaataaaaactgttgctgtttattcagaggctgatcagcatgcacttcatgtgcaagaagcagacagtgcctattatatcggtggcgctagagtatctgaaagctatttaaacatggaagcaatcatcaccattgccaaacaaacaaatacagatgccatccacccaggttatggtcttttatcagagaatgcagcatttgctaagcgctgccaaagcgagggcattgtctttattggaccatctgcacaagtcattcagcagatggggaataaaattgaagcgagaaaaacgatggaacaagcgggcattccaatcgttccaggtgtttcagctccgcttcatgatgcagacgaaggggttagtaaagcacagtcactcggctatcccgttatgctaaaggcatcgagcggcggcggcgggattggtatgcagctcgtccgcaacgatgaagagctgtatagagcatttgaaggaaatcaaaaaagggcacaaagcttctttcatgacggtactttatacatggaaaaggtgattgaacacgcacggcacatagaaattcaagttctttttgattcgttcggtcacggcgttcacttatttgaaagagattgttcactccaaagaagacatcagaaaattattgaagaagcacctgccgtctgtcttgatgacaccgtgagacagcaaatggggcaaatggccatcaaagctgccaaagcgattgggtatgaaaatgcgggcacaattgaatgtttagtcgatcaaaaccagcaattttatttcttagaaatgaacacgagattgcaagtagaacaccctgtcacagaagaaattacaggtattgatcttgtcgaggagcagctgaaagttgcagcattagagcccctgtccttcagtcaggaggacattcatcaaatcgggcatgccattgaagtccgaatatacgctgaagaccctgtgacattttatccgtcaccaggtacgatcactcaactttctacacctgacgccccatatatccggcatgagtcaagcgtaacgagcggcagtgtcattaccccattttacgatccgatgattgcgaaaatgattgtgtacggtgatacacggaaccttgcaatagaacgattaaaaacggcattacacgcatatgaaatagaaggaatcaaaaccaatctgccgctcttaaaagaaatggccggatctactgcctttttacaggggagcattacaaccgattatctgatgaaaaaaagggaggaaaaccgttcatgaaaaccgtcacgatacaaatggctggaaacttatggaagcttcttgtgaaacagggcgatgaagtgcaaaaaggacaggaagtcgccatcttagaatcaatgaaaatggagattcccattgtcgcagaagaaagaggtgtaatcagtaaagtgtataaagcggaaggggaatttgttgacgagggtgaggtgctcttggagctgacagaatagggggaagcagcatgacattaccaaaaaacgtgctcattagagaggtcggcccgcgtgatggcctgcaaaatgaatctgtttggctggacacaatggagaagcgaacatggatccatttactcgaagaagcccgtcttccctatattgaggtcacctcatttgtccatccgaaatgggtaccatccttaaaagatgccaaagaattagctcaatcattaaacaaaaaagatgatatcacctatgccgcactcatcccaaatgaaaaaggattagctcatttttttgaagcaaaccttgaggtaggggctatgtttatctcagcgagtgagacacacaacaaaaagaatatgaatcgatctatacaagaaacactgcctgtgatgaaacaaatgacagccgatttaaaagcagaaggacggcaaactcgggcatatatttctaccgtgtttggctgtccttatgaaaaacaagtgccgatggaccaagtactgcgattaacggaacacttgctgtcctacggcattgatgaaatatcactcggagataccattggagaagcccatccgctgcaagtagaaagacgattagaccttttacttgaacgctttcctgctgataaaatcgctcttcattttcatgatacgaaaggaatgggccttgccaatatttatacggcattaaaagcaggcatcaccatttttgatgcctctagcggggggcttgggggctgtccttatgcacctggctctagcggaaacgtcgcgacagaagacgtggtgcacatgcttcacaaacttgggatcgatacaaatgtcgacctccctcgcttgatcaaagcggctgaatggattgaagcaaaagtggatcgaaccctgccaagtcactgtttacgcgcttttcagtctcacactacttgataaagggtgaatcacatgacatcattggtcgatttttcaatacaagatgatcacattggcatcatgaccttaaacagaccagcacaagccaatgctctatcagctgctatgctagaggaaatcaatcaaacgattcaagaaatcaaacatgatgaaaatatccgctgtttgctcattacaggagctggcgctaaagttttttgtgcaggagcagacttaaaagaacgacgattgatgacagaacaagaagccaaagcagctgtcttcatcattcagcaaacctttacagacattgaatccttgcctgtccctgtcattgccgctatgaacggacacgcacttggcggaggtcttgagctcgcgctcgcctgtgatctccgcatcgcaagagcgggtgcagcactcggcctgccggaaacaggactagctatcctgccaggagcagggggcacacaaagactcccgcgcctgatcggacccgggaaagcaaaagaaatgatctttacaggcagctctttacgagcagaagaagccgttcaaattgggctgattgaacgcatctctacagccgattcactgatgaatgatgccatctcactcgcaaaacaaatcaccaagaatgggccgattgctttaaaagaagcaaaacaagccattcaatccagccttgatcacaatttgcaaactggtctgatgaaagaatatgaagcctatatgaggcttattcatacagaagatcgactggaaggtctcaaggcttttcaagacaaacgaatgcctcattacagagggaagtagcaagaaaggggaatggttatgatcgaggaatatgaattaaagaaacatcgaattgaaaagggcggggcagaacgctatcatcaaaaaaacaaagaaaaaggaaaattatttgtccgtgatcggcttcatttgctcttagatgaggattctttcattgaagatgccatgtttgcagagtgcaaagatgaacacttaccagcagatggtgtcgtcacaggaaccgggcgtatgaatggcatgactgtttgcgtcatggcaaatgactctacggttaaagcaggatcgtggggcgtcaaaacagtagaaaaaatcattcgaattcaagaaacggccgagaagctcaattgtccgatgctgtatctagtcgattctgcgggtgcaagaatcaccgatcagatcgcaatgttcccaggcagaagaggagcagggcgtattttttataaccaagtcaagctgtctggacgtatcccgcaaatttgtttactcttcggtccatctgcagccggcggtgcatatattcctgctttttgtgacattgtcgtcatggtcgaaggaaatgcttccatgtatctaggttcaccacgaatggctgaaatggtgatcggtgaaaaagtatcacttgaggaaatgggcggtgcgaaaatgcattgcagcacgtctggatgcggagatattttagccaaaacggaggaagaggctattcaaattgcacgtgattatttaacctatatgcctgccaactatacagaaaaaccaaaaacgacagcagcaaaagcacctaaaccatctgaaaccaccatccaagacttaatcccaaaaggccagaataccccatttgatatgtatcaactcattgatttactcattgatgaagggtcattttttgaaatcaaaaagctgtttgccgcagagttaattaccggctttggcagaatgaacgggcagcctgtcggtctgattgccaatcagccaagggtaaaaggcggcgtcttattccacgactcagctgataaagccgccaagtttattcagttatgtgatgcctttcatatcccgctgctctttcttgcggacataccggggtttatgattgggacaaaagtagaacaagccggcattattcgtcatggagcgaaaatgatctcagctatgtcagaagcgaccgttccgaaaatatccgtcatcgtccgtaaagcatacggggcaggactatatgcaatggcaggcccagcatttgagccggactgctgccttgctcttccatcggcgcaaatagctgtgatgggtccagaagccgctgtaaatgccgtctacgcaaataaaattgcagaactcccacccgaagagagaacggcatttatacaagagaaacggaaggaataccaagaagatatgaatatctatgaacttgcctctgaaatgattgtcgatggcgtcatcccgtttgaccgtctaagaacggaactttgtcatcgattactagcttatacatcgaaagaaatgacatttactaaacgaaaacatccggtctatccggtctaaagggggcgtctttatgatcaacctgaaaccagaatggataccggaagaaaagcaggtccaaaaaacacgtttgcatcagtggatgaaatctcttggtttttctacgtaccactcattctatcaagccagtattgatcgcactgactggttttggagagaagccgaaaaggcggtcggcattcaatggaaaaagccatatgaagcagcattaggtcagcactcattcatgtggccgaaatggtatcagggcggcacattaaacatcaccgaaacggccgtggacaaatgggcagaaaaagaagagacgaagcatcgatccgccatcatttggagcaatgaagccggtgaagaaaaaaaatggtcatttcttgaacttcaagagaaagtgtgccgtcttgcagctggctttttgaaagaagggcttcgaaaaggggatgtagcgatcgtatatatgccgatgcttccagaaacggtcgctgtcatgcttgcctttgcaaagattggtgtcatttttagccccgtcttctcaggctatggaagtgagcctctcgctgtacgcattcgcgcgtcaggcgcatccattgtcgtcacagggaacgaaatgatgcgccgagggaagacgatcaacatgcgagaatgtgtcgctgatgccatcaacaaaacaacaacagtacaaaaagtgattgtgcacacttccgctaataccggatatcaagacgatgtccggttgaatgagttgttaaaagaacagccgatagccggcacgacctatgtgaataatgaagacccgcttatgatcttgtatacatcaggcacaactggtacgccaaagggagccgttcatacacacgcgggctttccgataaaagcggcttttgatgcgggtctatgtatggatgttgcaaaaggagaccggcttttttggctgactgatatgggctggatgatggggccattcctcgtctttggcggcttaatcaatggagctgccatcgttttatatgacggcgctcccgattatccagatgaacagcagctctggtcgttcattcatcagcagaaagtcactcattttggactttcacccacatttattcgttctgcgatgcagcaaacgattgatggggtcgaactgccgcatgtcaaagccattatttctactggagagccgtggaatgaaacgccgtggcaatggttatttaacaccattggtcaaaggaacattccgatcttaaattattcaggaggaacagaggtttctgggggtattgtaggcagtacgctgcttcgaccaatcaaaccgattctctttaatgcggcgatcttaggaatggcggcagatgtatacaatgaagctgggcaaagcgtgatgaatgaagtaggggagcttgtggtgaaaaagccatgggtcggcatgacatgtggtttttggaacgaaccggagcgttatgaagatacgtatttcaaacgatttgacggcgtatggacacacggagattgggtcatgcaaacagaggacggtgaattccacatcacaggaagatcggatgatgtcattaatacagcaggtaaacgcattgggccagctgaaattgaatccatccttgttagacatcctgccgtgcatgaggccgctgtgattgggataaaggatgaggtgaaaggggaggcgctcgtatgttttatcgtgaccagtccacatgcttttgaagaagcagccctcattcaagagctttcagcacatgttggttcacatgccggaaaagcgctcaagccaaaagaagttcatctcatttcagctttaccaaaaacaaggaatggaaaaattgttcgccgtttactaaaagcggcgtatgaagagcagacttcacccgacctttcttcattagacaatccagatgtatataaaagcctgaccgaatacttgaataagaaacagaaaaagtaaaaaagacaggaaggcccctgtctttttttattgcatatgaaaattcgtgccatctgttgtttctttgacaatacctgctcgaacgacaaaatcaccgaaatgttcttcgtcttctcgttcttttgcatagcggggaagaagagagccaagttcgtttaaaatgtcttcctcaccaacattttcacggtataacttacttaatctgctgccatcaaacgcagcgccaagatacatgttgtatttgccaggtgatttcccgataaagccaatttcacctagcgcatgacgggcacatccatttggacaaccagtcatacgaatcgtgatttctttatcacttaagccgttttcttcgacaatctcttcaattttgtcaatcaagcgtggaaggtagcgctctgcttctgccattgctaagccgcatgttggcaaagaaacacaagccattgagctgcggcgcagggcggagtgttgctggccgtctgataaaccaaacttctgaatcagctgttcgatttgtttctttttatgagttgtgacattcccaatgattaaattctgattggcggttaaacggaagtcacccgtatgcaccttggcaatttcacggatgcctgtcatcagtggataatcatcataatctgtgatgcgtccgccttccacaaacatcgtataatgccatctgccattaatgccttttacccagccataacggtcaccgttatgatcaaagtgataatcctttgcctctaacagggtaaacccaaggcggcgctcaagctcttcttttacattttcaagaccaagacggtccaccgtatatttaaagcgggcattttttcgcacggaacggtttccgtagtcacgctgaatggtaatcacttgtttcgcaatctctacaacctgttccggtgtacaaaagccaatcacttttgcaagctgaggataggtcgctgtatcaccatgagtcatacccattccgccgccaattgcgacattaaagccaatcaattgctcattttcgatgatggcaataaagcctaaatcctgcgaaaagacatcaatatcgttagcaggagggaccgccacaccaattttgaatttccttggcaaataaagcggaccatacatcggttcaacttccgtatctggcgttgccgcaaccttttcctcatcaagccaaatttcgtgataagctcttgtttgcgggagcaggtcatcacttaattttttcgccagctcgtatacatcatggtgcacttctgattgataggggtttgatgtacacatgacattccggttcacgtcgccgcaagcagcaattgtatcaagcatagtagaatgaatgtcttgaatggtttttttcatattccattttaaaataccgtgaagctgaaaggtttcacgagtagtcagctttaacgtaccgtttccgtatttgtgagcaagctcatccatcacaagccactgcttagatgtggcgattccgccaggcaggcgtacgcgcagcataaattgataggctggctcaagtttttgtttctgccgttcatttctgaggtcccgatcatcctgtaaataactgccgtgatgtttcatcagacggttgtcatcatcaggaattcccgctgaaatcggatcaagcattacttcttttaacgtaccccgtaaataatcacttttttctttgatttcttctacgtcgctcggaggtccatccggcgctgttaatgctgtcttcaccatgtaagtaaaagctcctttctttcaagcatcaagtccattaatatacgtcgcgctgatagcgtttttgctgctgcaagttagctagatagctttctgctttctctttgctcatcgcaccttcttcttggataatcgatagaagggtatgatgaacatcatgcgccatatacttttcatctccgcaaacatatacataggcaccttgctccagccattcgaataattctttactttgcttcttcatttgatgctgaacatatactttttcctctgaatctcttgaaaaagccacatccattttcgttaagacgccatcttttagccacttttgccattcggtttgatataagaaatccgtcacaaagtgctggtcaccgaagaataaccacgattttccgcttgcaccgatttcttctcgttcctgcataaacgaacggaaaggggcaatacctgtgcctggtcccaccataatgatcggtgcatcagggttttcaggaagcttaaagttttgattgtgctgaatataaacaggcagcgtatcacctggttgtaagcgctctgcacatagaatggagcagacaccttgacgttctctcccgtgcgcatcatatctcacagcaccgatcgtcaaatgaacttcttcttcattcgctttcaggctgcttgcaattgaataaaggcgagccggaatttttcttaaaatcgcagtgaagtctgcggctgttccttcaaaaggaccgaaatcgcgcgcagcatcaactaaatctcttcgtgctatatatgcttttaatttttcttcatttccttcttttaaaagggcatggagggcttcatttttcgtcaagtccgccaacttttgaagaaggggttttgttaaaactgtaatttcaaaatgtgaggtaagtgcttcttttaaaggaagagtctcaccgtttttatgaacagttacggcttcttctgcattccatccgcatgtcgtaatcagttcatcaacaagcgcaggatcatttgttggataaattccaaggctgtcacccggttcataaacaagtcctgacccttcaagtgaaagctccaaatggcgggtttctttgttagagccacggccgtttagattgatattttcaagaacttccgcataaaaaggattcgttcttgagtattcagtagctgctgtttggctgtttggtcctgctgattcttgcgtgaaagctgcggcttcaccttcgctaagtgacgatgtcaccccttgaagccattcagaaaacggctcatcataatcaaggtcacaatccactcgatctgtcaggcgcgttccgccaagttctttgaagcgctcatcaaattcttttccagtctgacagaagaattcataggagctgtcaccgagcgatagaacagaaaagcttaaatgatcgagctttggcgcacgtctaccatggacatattcatggaaagaaagggcattgtcaggcggatctccctcgccatgtgtgctgacgatcatcagtaaattgtgtatttttttcagattatttggtttaaaatctgacatagaagagagcgtcacttgaaagcctttctcttcaagatgctgtgctgtctttttcgctaacccttcggaattgcctgtttgcgacccgtaaagtacggtcacatctttactgacaggctgcgcaggtgctgcggcagaaggagatagggcttgagtagctgtttctgatccggctagcgcagcttgtgctgataaataaccggtaagccaaattttttgttgatctgttaaagtcggaagcagctgattgagtagctctgcctgctgctgactaaaaggactgttcaatacatgaagttgcaacgatatccacctcacaaggaatataaacatagattaattcgataggaattatatatataggttcaatttgaactttaccgaaagtttgccattaagtaaaatatataatattgattgtcatgattaagatttctaatgacaaagcatatgcgaataggggaaaagacataaaaaaaggaaaacggtcatccgttttcctcttatctatctaatttacgccgttggaagtcccatcacagctttcacttctaaatattcctcgatgccgaagtctccccattctcttccgatacctgattgcttaaagccgccaaatggggcaaaataatctgtttcggcattgttaatggtgatttgaccagcgcgaatatgctcagcgacatattttaatgttttttcatcttttccaacaacatacccggcaaggccatacactgtatcattggcgatctcaagggcatgatcaagattctgatacgtaatgacactcatgaccggtccaaagatttcttcttgtgcaatggtcatgtcatttttcacattggtgaaaatggtatgtttggcgaaatatcctttatcgattccgtccggctttccagctcccccagcaagaagggtagcaccttcttcgattcctttttcaatataagattgcacggtatcccactgctttttagatacaagcggccctgtagcatgatcttctcttggatcaccaactgtaaacttcggcagggcattcagcagcgctttttcaaacttgtctttcattgattctggtacaagcacacgcgtagctgcagaacacacttgccctgtattcatcgcaatatgctgaatggcagtttcagcagccacatccacatctgcatcatccaagacgataagaggggatttcccgccaagctcaagagcgactttcttcacattgtccgctgcgttttccataattttagtgccaacagcacctgatccagtaaatgaaacaaagtcaatatcaggatgtgagctaatgccgtcaccaattacgtcacccgttccgtttactaagttgaaaactcctttcggtacgcctgcttcatcaataatttctgcaagaatcatcgcagcaaatggtgtaatttccgctggctttaagacaactggtgagcctgccgcaatggcacctgcgattttaagagatgtttgattcgttgggaagttccacggtgttatcaatccgctgacgccaattgcttcttttataatggtatgtccgccgcggtcctctgtaaatgtataagatttaagggcttccgctgctttagaaaaatgttcatagcccattttgtaatgaacttcttcggatactttcagcggtgcaccgagctcttgtgtcatcacttctacaagttcatctttgcgtttttcgtagccgcgcacaatgttttccagcatctttactcgttcatttcgagatgttttagagaaagaagggaaggcggcacgagctgctttcactgccttatctaaatcttcttttgttcctaagctaatggtgccaatgacttcctctgtcgcagggttgatgacctctgtcgtttcgcttcctgttgatgcaacccattctccgttaataaaatgcttctcttgatttctcattctgacatgtctcctttttatatgtgattcattcaatattctgttttcagctgatataaaactgtacccactgtgaaaaatctaaaacgaacaaactgcaaaagaaaaagtttctgatataatacgcaaagtgggacatatgtccttttcaaccggcgggcatgtatcatttaatggaactagactgaaaaaagaaggagcttttgaacgaatgaaaggtgttatttacgctttattaggaggcgcttgtattacactacaaggcgtagccaatgcaagaatcagccaggatattggtacatggcaggcagccaccatcacacagctgaccggctttatcatctcactcgtcattttactcgtcgtacgagacgggcacttcagggaatatcaaaaggtgcagccactttatttaataggaggcgcatttgcagcgattattatttttaatgaagtcaccgcgatccaaatcatcggtgtgacactcactatcgcagcgttactgattgcacagcttgcttttacctttgcaatcgatgcaaaaggatggtttggtgttcagaaaaagaaaatgaaatggcctcattacgcaggaattttattgatggtcacaggggtgatcattttaaaactataaaggagggcgtcagatggaggagcttcatgatgaatctctttttacctcatatatgaaggcacatcaattagaaagtgtctttcatcaaaagctcatatcacacgtaagtttgtggcgctatgagcaaggggagctcgtttgttcaaaaggggataagagggagtacctgtacttgttagtgaaagggaaattaaagattttcacgaccacaaaggaagggaaaacctttattcttagctttaaacatccccttgaagcgattggagatatcgaatacgttcagcagacggatatggtcaatacagtcgaagcggtcacagaagtacatatgttaagggtttctcatcaagcgctcatgcgtcatgcgaaggatgacccacgcatgttaacctttctgctaaaagggatcacaaacaaattttatacaaaatcaaacgatttgagtttccacctgttatatcctgtagaggtcaggcttgcaagctacttattgtctgttgtcacagatgatgacagcgcaagcgcccttcgtctcactgatgcggcaagcttaatcggtacaagctaccgtcacattaaccgagtcattcagcgattctgtgaaaaaggactgatagaaagacagagaggaaaaattacgatttgtgaccgcaaagggctcctagaaatagcagagcacaacatttatgaatagaggaaatgaagggatttatatatgatcataggaatagtattagccatcacggctggcgcactcgtcagcttacaaaccatttttaacagtaaggtcaatgagcagacaggctcttggtcaactaccaccctcgttcttggaatgggctttattgcttcactcctgatggggctcttactagagggaactggcatgtttcgattaagacatatggaagcgtggtactggatcagcggggctattggtgtaggagtggtcatttgtcttgttcaaagtatcaaacggcttggaccgacttatggcatttcgattgtcctcacgtcacagcttggctgcgctcttttgtttgattcgcttggctggcttggcttagaaaaagtagaattctctttgacaaaacttttaggtgttattgtaattgtggcagggatcttggtgtttaaattgaccaaattggagtctgcagaaaaagatcaaacgcaagaaaaagggctgccacaagagtagctgccctactttatatcaatcgacgccataaaactgttatcgcggataatccgtttaaaaggagccttttcatcaaaggcttttttttctgtccataagcgctcgtctggtagacagttcgatctttagcaacgagataactgtaggcgatttttcgttcaattgcttgcgtaagtgataacgcaaacggggcactgtcaatgaccaaaatggactctgtgtttaaaaaactagacctcgcatctaagttatatgtcccaataatactcaggtaatcatcaatcaccattgatttcgcatgaatcgaatatggaccttcgtattcatacaaatgaacgcctgttttcatcaattccttttttgtacttaaatatccagcaaaggctaatggatttggcgtcgccgtaagagaattcgtcaccactgtcgtctgaatctcactaggtaagggggtgagtccggatttcattgggcgtgttggaatgacataaggcgtctgtataagcacagaacgctttgcccggtgcgcaagatcgttcagttttttcagcacaagtggccgcttattaaaacgttccacaggatttgtgaaaaaggcaacctgtttcacagaagtggaatctgctgcccaatcaaatgaggacatcacaaaaggttctttcgtgcgcactgcatcatgataagatctgagcagctgttttcttagctttaacccttttttcgcttttggcttagagaacacagcttttgttctttttgtgaaatcatgattccaaagataaacgaaatattgctccatttcatctaatacttttccctttttgggattatagagcagcacatcacggtcaaaagcaaagtctttcggcggctggtctgcaaagtatttatcaccgatatttcttccgcccatcacagccactcggccatctgctagtagcagcttatcgtgtagccgattatgccacgtccatggcttgaacaaacgaaagggctcataaaaacgaatcgacatgtttggatgatttgctacagcatagcgcaaatgctttagcggaccgcgcaaactgtgacagatgccatctaacaacagctgcactttcacacctcgatcagctgcttcaattaaagcacctagtatccattcggctgtttttcccttttgaatggaatagtaactgagacggatcatcttctttgcctcacgaatcatttggatcctcacctgaccagattcaaagccgtcgtcaagaagcatgacttgatttgtcccctgatcgtctcctgagatagaagaggctttataaatgcaatgttctttgcatgtttttcgaacaggtaaataaaacaaaacaaatgcggtcaaaaatacatagacgacataaacaaggatgagataaaacaaaagatgaagcattatgatcagctcctttcacacagacacaacttttccttagtgtatgtcaaaaatgaaatttcactcatgttggctttcaacaaaatatatgacaaaagaatcagcttgtttttattgggcatttaattatagtatgaaatgagtaagggggaatcaaattgaatgaaccactatttaacattccaaccgaagtgtatcaaacgttaagtgaaacagaacgttatttactcaactatattcaccagcatttagaggatatctccaccttatccatcgtcacattaagtgaaagagccaatgtgtcgacagccacaattgtcaggctgatgaaaaaaatcggctacaacggctatacatcctttaaatatcgattgaaacaagaaaagaaaatgaccgatgcaagtgatcagctcaaaaacattgatgaagacatcaaactagcgattcggaaaaacgaagaagaggttttaaagacgatccagctgcaaagtattgggcaaattgaagatgccgttcaaaaaatacataatgcggacaaaatttatattttcggcagaggcttttcagagatgattgccaaagaaatgaccatcaaattacagctcatcggaaaaacatgtgaagtacatgacgacccgaatatcattcggctgaagtcgcgggatatcggtaaaaacgaacttgcaatctttgtttcattgaatggcgaaacagcagagctcgttgaagcgtgtcaaaatcttagcatgaagcaagtcacgacgattaccgtcacaacgagaatagattctacattaagtaaaatatcagatatgactctagtcggatataaaggcgaacaatccttcttcccagattatgaggtcagatcgcgcttgtctcttcatgtcatcgcccgcattttactagatgcctatgtgattcgaatgaaataatcaataaagaagccttcgagactttgatctagaaggctttttaacatgaaaacctttacacaatctgaaaacattttcactcctgcgtatgagatactttctttagagaaaagaaagaaggtgaaaccaattgatttatacctgcaccttaaatcctgctattgacctatatattgcattaaaagaaatgaaggcaaatgcagtcaaccgcacggaagatgaagattatcagccaaatggcaagggagtcaatgtctccattatgttaaagaaatatggattcaccagcactgcattaggatttattgctgggttttcaggctcttatattgaacaatccttaaaggacctttccattcaaaccgattttatctcagttgaaggaattacacgcattaatgtttttattaatacgactgaagaatacaagctcgtgaaccagggacctgcgattgaagaaaaagcgcttcacgcctttcgtgaaaaaatagcggccatcccgcagggggacatcctgatcatgtcaggcagcctgccaaagggcgtaccagccagcattttttcagaagtagcagctatttgtcatcagaacaacgtcaagtttattttagacacaagttccgcagcagttcttgagacacttcaatataagccgtatttattaaaaccgaatgaagaagaaatcgctgcttttttcggcaaaacacatcctatgtcagaaaaagaactcattcaatcaggagaaaagctcattgagatgggtgcagagcaagtgcttatttcccgcgggggagaaggggctttgttcattacaaaagacgccgtcttaaaaggaaacgcaccgactggcactgtggtaaacacagcttgctctggagatgcgatgctcgcagcctttcttagtaaacagcttgaaggtcattcacctgaagaatgcttacgttacggcattgcaacaggcgcatctactgcattttctaaaggcttaagtgatttacatgacattcattcattaattgatcaagtacacattgacaagatataagggggaatacacatgagccgtaaaaaaattgtcgctgcaactggctgtccaacaggcattgcacatacatttatggcagctgaggcattaaaaatagctgctgagcaactaggggtcgacatcaaagttgaaacgcacggtcaagtaggaattgaaaacgctttaaccgatcaagacattttggaggccgatggagtcattgtcgcagctgacaaagatgtgaatacagatcgttttcacggcaaaccactgattgaagtgcctgtagcgaagggtatccgcacgccaaatgaactgattcaaggcattatgaatggagaagcacctgttcatcaagtgaaaggaagaacttctggaacagaaaaaacatctgctccttcaccagctcaacaaaagtcggcgaataagtggatacacaccatctacaaacatttaatgaacggtgtatcacacatgcttccatttgttgttggaggcggggtcttaattgctttatcttttctattcggtatttactcagctgatcctcagcatgaaacgtatcatccgtttgctgcctacttgaaaaacattggcggactcggctttagcttaatggtgcctattttagcagcatttatcgctgattcaatcgcgaaacgcccagggatggttgtcggatttatcggcggcctgcttgcaaacgatggaggcgccggattcttaggtggtattatcgcaggttttgcagcagggtatatcatcgtactccttcaattcctgcttcaaaaattacctgcatcacttgacggattaaaatcaatcttcatctatcctgtcatcggtattttcttaattggggctgtgatgacaccactattagttccaatcacaggtctaaataattcattaatggattttctctcagctgttcaatccacgaatccgctgctcttaggtttaattgttggagcgatgtgtggatttgatatgggaggaccttttaacaaagcagcctatgtcacaggaacggctttacttgcagaaggtaacctttacttcatggcaggtgtgtcagcagcatgtatcacaccaccgcttatcattgcgattgccacaacgattttccgaaaacatttcacaccgcaggaacgaaatgcaggggccatcaactatattctaggagcgacacatataacagaaggggccatcccatttgcggctaaaaacccgatcgttgtcctgccaattatcatgtttggctccgccatctctgctatattgacgtatctctttggcgtacaggttccagctccgcatggtggattccttgtccttccagtcgtcacaggtgcattccagtgggtactatccatactgatcggatcacttgtaggtgccattctatacggactgtatcgtaaaaaaatagacaaacccgcagtttaatagggaggaagagaaataatggaacatatttatatgaatcttcatgaaaccgcgtcgtcacaggctggcgttttcgcagctattgctgatattgcctacaaagcaggtatttgtacatcaccagaggatgtgaaaaaaggcttagctgaaagagaagcactgagcacaactggatttcaagatggatttgccattccgcatacacaaacagacgccatcacaaaaccagcactcgtgatcgtccgcacagaaacaggcattgaatgggacgcttttgatgggaaaccttgctttttcttcttatccttactgatccccaaaagtgaagcagggaccactcatctaaaggcactttctgccctttctcgaggattaatggatgaagcgaaacgacaaaagctgctggaaacaagaacaaatgaagacatgctgactgtattagaaacagatattttaacgagagaggatgtttgatcatgcctttactatccacaacaccgatgcttgagactgcgaaaaaagaaaaatacggaatcgttgcattcaatgtacattcctttgacagtatttattgggtgctcgaaacggcggcagaattaaaatcacctgtcattttgcaaacaacggttggaaccgttcaatctcttggagcaaaagcgattgcagatacagtcaaagcggcggctgatcaatatcaaatcccgatcggtctgcacctcgatcactgtacggactttgatgtgattctcacctgtattcgtgcgggatatacatccgtcatgatcgatgcatcgatgcattcatatgaagaaaatgttcgccgcacaaaagaagtggtggacctcgcattaaaagtaggggtgaacgttgaagctgaactaggcaaggtgggcggcgtagaggatgatatcgttgttgatgaaaaggatgctgaaaaagccattccatcagaatgccgtcaatttgtagaagaaactggggtaccaactttagcacctgcaattggtaccgcacacggcatttataaaggggtaccggatattgactttgaccgtattgaacaaattgcatcgctggtcgatgttccccttgtgctgcacggtggttccgctgttccggatggagacgtcagacgatgtgtggcacttggtatggcaaaggtcaatgtctcaactgaattaaaaaatgcgtactctgaagccattcgtgatcatttctcaaacgaaccggaaagcttagatccacggatgtatttacaaaaagcgaaacaagccgcaaaagatatggtcacatcgaaaatacgtatcgttggcagtgagggcaaagcccatcctctatatcagtgaaacaaaaaagcagagccgcttaagctctgctttttcacattattcgttttctttcatttcatttgatgtgcgtacacgtgcatttcccatgaacaggaccgtaatcgctgcaagagcaataggaaacaacgcaatcaaaaatacgtacgtaatactttgtgacatcgcatcaatgactttatttaaaatatcaggcggaatttgtgagcgggcaccttcttgaaaaatggcttgtggatcgcctatttgagaagaggcacctttcattccgctaaaggcttctgctaagcgattcgataggacattggtttgaatcgtcccaaaaatcgtgacaccaagtgtcatcccaagtgatctcataaatgaattggtcgagtttgcactgcctcgataacgaggggctagatcattcattgaagctgacggcagaagggagaagctgaagccgacaccaaagcctgatatcatcataaagattgtgagccaaattctagctgtatctggtgacatattggcaagaagcagcatccccgcgaaaaatgaaataacagagatcgtcataagacgtctgaaaggcactttcgtctgcatcgttccgccaatcatactgccaatgacagaccctatcatcatcggtgttaaaatgaaccctgcacttgtcgctgattcaccgtacaccgcctgaacgaaaataggaatgaagacagcaagaataataaatgttccgccatataaaaacgccaaaatttgagatgtcgcaaataaacgatttttaaacatccaaaatgaaataatcggttcctctgcttttcgctcaacaataaagaagatggtaccgaacacaagaaacacggcaaaaagggtgaggatttgcactgaatcccacgcataagatttaccaccaagctcaagtgcgaacatcaagctcacaaccgccacgacaagtgtgatagcacctgaccagtcaattttttgcttgcgatgttctagtgattcctggtagtatctagcaatcaagaacacactaacaataccaattggcacgttgatatagaaaacccagtgccagccgattgaatctgtgataatagctcctaagagcggtcctagtacactcgataaaccaaacactgcaccaaacataccggacatttttccacgcttttcaggcgggaagatatcaaagatgattgtaaacgcgattggaagaagggcgccgcctccaagcccttgaatggctcggtaaataatgagctgatccatcgtttgtgcgataccgcacagcgctgatccaattaaaaagaaaataagtccaaacagaaaaaaacgctttcgaccatacatatcagaaagctttccgtaaatcggcattccagccattactgccaccatataagaagccgtcacccaagcaaatttatcaaaactgcccaaatctgctacgatgcttcccattgctgttgcaacaatggtattgtccatcgccgccataaaaattcctaacagcaaaccgatgacaacaaagcgagtggatgccttgcctttatccacatgattcatttcatttacctcctgcttacgttctctccttatttttgctatgatcaacttaaatataaagtaagagaacatttatcttgatgatcaagataatttattttaaagggaggagaacaagttgtcaataaagaacgacgcagaagacagagcagacctgatcatccatacaatgaggcgcctcgccacacgaacggttttattccaccaagcggccgcacaatcgcttggccttttcccaacagacctcaaatcagccgatttattaaatgaactcggtcctctcacagcaggagaattaagtgaaaaaacaggtcttagctcaggtgcagtcacagctctgattgaccgccttgaaaaagcgggctacgcaaaaagagaaaaggacccaaaagacaaacgaagagttatcatcgttccattaacggcagggaaatcacaggtaagagaactcttccaatccttatcagcatcaaccaaacagcttacaaacgaatacaaacgagaagaattagacttaatcattcaatttattaccgaagcagcagatattatggaccaagagctgcaattgcttaagtctaagtcgtaagagagcataatgcgaagggtgtgcttttctattagttgtttaaaaaaggtagcgcggattataattggctcaattagtgccctcttccttaccatggaagtgctctattacacttgtttacaatggaacatctcaaatgattttaattaaaagatgttttaaaaatcgtgtcttaatgattactgacgattgctaggctaaagcgctctaataaaacacggatcatttacatattaagtactgtttttgtatctatattcctatttaatgacaaactttgtgttggtaaaattgaccttgtcaatgaataggaaggagtgaattctgctggggaaaatacttgatgcaaaagcacttgaaagtgccatggacgcaagagcaaaacactaccaggaactccgcgaacaaatggtagatttaaaaaaagcattacaaggtgtttctaatctcggtgactcgacatatgaaatggagaagatgtttaagcgtgtgatgtagcaaggtattagatggtgggtgaataggtttgcccaccatttgcccaccgattaattttcaaggtacttttcaaagcgcaaaacgctttctgtttcgtgtttttttgttacgtgaagataaacatccgctgtcatgttgatggtagcatgccccagtctgtcactcactgtttttatatcaaccccgctttcaaggagcatgattgcatgagtatgtcgtagcccatgaggtgtaatgtgatgtaaatttgtttttgacaggatcgagtcaatagctttattaatcccaaatgttcctatatctttcccattgggtgatgctatcaaaaaattaggttcttgatatgcaaccccatatttaattttgtttttcttttgccatgtacgatacttttttagttcagttattaatgtgtcatcaattgcgattgtacgaatactagactttgttttaggtatctttaccccatattcatttcttgatttattaatccgtatcgtcttttggttaaaatcaatgtcatcccattgaagagcgatcaactctccttttcttatcccagttcttaataaaattaatgcaatgatgtaatgatggaaacgggacttttttgcagcattaataaatatattcacctcatcttttgtaaggtaatttatcttgtcatcatttacattactatttttttttatagaaatatttgaatacttattatgcgttaacatttcaagttctactgctttatttattgctgaacaaaatattgaatgtatggtttgaactgtagatttagcatacttgtttaatagattgttgatatatctttggtaatcaactctttttaattgacctaatttgttctgtccgagatgggggatgatattcttttcaatatacaatttacggttctttaaggtgctaggctgacattgagaaccgtaaacatcaagccattcatataaccagtcttttaataatacctctttactttggattatttcatgttgacctaaataaatctgtttttcaatttctgctgcttcaatttgtgcttctttctttgttctaaatcctcctttgcttttttcttttcgttttcctttagagtcagtaaagataatacggtattcccaactcttacctcgttgtctaaagctagccaagatagttcactccctgcttttatttccagacctattaaagagcatatgttcgttttttgtttaaaaaaatactgtggtaattttgtacaagttctttcggaataccatattccttaaattcacaataagtaatacccctttgaacggaagaaaacaataaatgcatagcaaaaaagtttgcttccagttcaattttttcagttgaatagaaagtgtttctttttaaaaaaggagtattagattcgctatgaagtaaagcatgtcctagttcgtgggcgcaaacaaagtaaccacatttttcacttactttttcattgatatgtatgaattttgtgcgaaaatgtttgctgtagtaccccagggtattccctaagtcttcatgaattgtaatgatattgagtttgttggcaatgaaataaggatcagatgacttaaatctactttgtaattttgaaacaatttcagtaatatcgcccatgatttaaaatatcattccttatctatattttttaggagtgtatttttgttttgctattttctttgctattctcaaagtgttttcaagactagcgattaaaagttctttatcttcttcttccatgtcatcaatggtttgaccgtcaaaagcagcataactattcccttcaagtccgtttatgatgttttgcaattctttttgtatgtccttctcatcttttcccgttaattcaatacttcttttaacttctgtgcgccctaataggtaatcagttgatacatcgaaataatccgctaccttttgtaacgtctcacttttaggagaaacattgtcccaccttctaatttgcccgtttgaaatacctatttgtctttcaacttccgcaaaagtgactttcttttcatcgcaaagcccttttattcttctaaccaaactcattctgaccaacctttctcaaggcttatcgaaaacaaaatgacttaaaagtcaatattttatattgacacgtgactttaaagtcattatactgtgatcataagctaattaattagcaaaaaagacaataaaaaatgtacccaataaaatacactttcgacgctggggagcaatgaaatgttgtatatttaaaggcttttataagtcttatttcgctatggattaataatagcaaaaaagtcattttgggtcaatgagaattagctaattaattagccttttatattttttggaaggaggctcaacttgaatcatgtcgatcaacggagctataaaagtgaaatcagaaatgtataaacaaggaatcactcaaaaggaattagctgaaattcttggtgtatcgggggcttatgtcagcgatattatcaacggaaagaaaacaggaaagaaagcccaagaacatgcaaaacatatccgaaaaatcttaggcattaaaggaagtgaggaataaatgctaacctttcaaattgatcaaaatcttttagaagaacaggtgtcaaaggagctttcaaaaagacttgaagcgattgaacacagggttacattttgggacacaaaagaattgtgtaagcaaacaaacatgagtctcaacttcataaaagaaacattcttttacgattcgaggtttccaaaatatcgagtcggtacaaaatggctttttcctgcaaaagaatgcgaacagtttttaataacttggctgaaagaacaatccaggggataaagttttgtttgttccccaaaagtggggaaagacgcaaattaaatatttataaacccgaattgacaggaggaaataaagatgaacaccaatacaaaaaatccttatgcacctggtccggtgaaagtatggaaaatgacgaaagaagaactcgaagcgtatatagaaaagcatcctattatctaccgagaggaattaaaaccgtcaccaaccttccgtacgggtaattggggggctgaaaaactgtgagtctaccaaaacatatcgagttgttgcacaccgtcaaagcctgcaaaaaccaaacaatgcaaattgaggacgcagcgactcatctaaaagtacctgattttgtcattccaatgttagtcaaaaaaaatgatgacttgagcattcaagggaatctgattctagcaaaaagcgattcaatcggacaaggcattttcatactactaactttcattagcatcatcattattaccggatttttcggagagtaaggagtcaagccgcttatgattttcatcacattaaatagatttataggaggtacaagcatgactaataaaatcgtttgtccaagctgcaagagtgaaacgggcttttttactaaagaaaggatcacgggttcagctaccgtttattacaattcaaatggagatttggaagaagatcaaagcacaatgtatgattcgatattacattatggaggttcaaaagcgtattgccgaaagtgcgaaaaatttatggggcgtactgatgaattgtggagcggcgatagagaaggaatataaaaaactgatccgctcgggatcagtcaaacttcttacttgtacattatagggttgttgcaagtaaggaaggtacgggaagtgtagaagcttccacatattgatttgactttaacatgattaacaaaaaaatacaataatcaaatttgagataaaaaggggatttttctaatgaaattaatgggtacgcctgcaaaggtttctacagttagagcaaagttacagcatatcggacgtcaagaagataaagaggctcatttctatgatgcgggcatggtatccgttttaaaatatgttgctgccaaaacaattcatgaaacggaaggaacagaattcgaatggtctgatgccactttacggacacaagagaacgtggatgatttgtacgagaaattagaagggttgttatctcatgcaaatgattttgtgaagctattgaaagaccttgatgatgctcaagcagcaaaagccagtcttgaaattgaagatgcttatgtaactggattcgtagaaggtttccgctatttgatgggtgaagcagcatacagacaaaatgtaaattttctaaagtaaggtgatttcataatggtcggttggattaagttgcataggaagattagaagtaaccccattttcaatgatccgcagctattaaggttatggctaatatgtctaacagaggcttcacatacggaacatgatcagatagtgggtagacaaaaagtgaagctaaagccaggtgattttgtaacaggtcgttttgctttgatggacatgtacaataccggtcttaaatctaaggacagggtaaagggagaaaagacaatttttcgttggttggaacagcttcaagaaatgggatatttgacaataaaaaagaccaacaaattcagcattgtaagcattgataattgggctatttatcaagatggagcttccgaaaacgacaacagtctgaccaacaaaagaccatcaaatgaccatcaaatgaccacaaacaagaatgtaaagaatgataagaatgaaaagaagataaataattctcgtcacaagtacgaaccttgtgacatggagaatgccaatttgctttatcaaagaatcattgaaaataatccgcaagctaaaaaaccgaacctggaaaaatgggcgagtgattttagattgattaggcagatcgacaagcgaacggatgcacaggtgaagtatttgattaactggacacaaaaagatagtttttggaaatcgaatatattgagtcctgcgagtcttagaaagcagtttgataaattgaccgtaagaattaaaagcgaaagagaagcagcaaagagaaaagcggctgtgaatgaaaaggagtttgatttgacagatgactaaagcagagacattagagttacttaaactaatcaagacatattatgagcattttgagtttgatcaaacaaagctagacgcatgggctagaatcttaaagcccgagaattacgagcggatcgaggcgaatttgatcgtttatgtgaaatacaatcagtttccgccaaaagttgctgatctaatcaaagcgaaagaagcaagaacagatcggtccgcagccataccgaacgttgaggaaactcaaagctatctttctgaactggacaaggctgaaccaacccaagaagaactagaacagatcgagcagcataaagcaaagatacgaaaattgcttggaataggtgaaccgtcatgacaggaaacatattttatttcaacgacgaagcggaacaacaatatctaggcgcaatcttacaagagccggatttgatcaaatattcgcagctcaaaccaattcatttctaccgaaagcaaaatcaatccatttacaaagcctttcaagagctggataaaaacggcgatcctatcgacatagtgtcagttattgaacatgtgggacgagaaaacctaaaggggatcggcggaagaaaatacttaactgaattgatgaatgcctcaatcactacagcaaaacaagcattctatgaaaatctaataattgattattggaaaaaacgagagattgcgaaagtgggtgtttcgcttaaagaatcttccaatagcgacgatacgtgtcaaactatacaagagggtataagctctcttatgagtttagaggatgcgacaggcacggacgacgacgggtctatcaataatgacctagttgaaatctatcaagagttagaaacgcctaaaggtgatgtaactggtatgcctagcggctttactgaattggaccgaatgacgtcgggttttcagcggcaagaatttataatcgtcgccgctcgtccatccgtaggaaaaaccgccttttgtttgaatgtagcaagcaatttcatggaaaacccgcttaatttaggtaaaggcggagcggttggcatcttttcgcttgaaatgtcacgtaagcaattaataaaacggatgcaatcaagtatcggtaacattaatgctcaatccatccgcacaagtaatttaaacgctgatgagtggggcagattaagcaaagtgaacggggttttagattgtgccgctcttagaatatttgatcaaccaggcatgacgataaatgacatttgggcaaaggctcgtaaaatgaaacgggaatttgaaggcaaggacatgatgatcattattgactatctgcaattgatcgtcggaaatccagtccacagaggaaacagacaagcagaaatcggagaaataagccgtatgctcaagcaaatggcaagggaattggacattgctgtcattgcattgagtcagctttcacgtggagtcgaacaacgccaggagaagcgccctatgatgtcagacattagagaatcggggcagatcgagcaagacgctgatgttattgcatttctctatcgtgatgactattacgacaaagaaacagagaataagaacattattgaaatcattattgctaaacagcgtaacggtccagtcggtacggtttcactagcgttcgtcaaagaatataacaaattcgtcaacctggaatatagggaatcggcatgacggttaaagattggtataaagaggcgataaagctcaatcagtacgccttgatattgctgatcgaattcctagtatacgaaaaggcagtaataaaaatgacggatcaagaagaacagcttttcttttacctacagccaaaatttaaagaaaagatgaatgagcatttaaagaactatcatacaaaaattcaattggaggaatcgggcatatgagcaatgaaaaagagcggttaacagaagatcaaagacaattttttattgaatggctaaccgttatcgggcgagggtattcacgggagttttacgagaaaatgaatgaccaggaactagaaaagcaatatttgcttaacgtgccccaagaagtatgaacgagccaacgatctttattaattcgcgaccggaaactataattatcatccatgaccgtgagttgttaaagagaggggttataagcaaataatgataaatcattttatttaaggagagtgttgtaccatgcgtcaaaaaaattaaaccatcttgaaaagatggtttaacctctaacttttaaatttttcaatagtagctgacacaaagctccttacagatgatatcttgttctgtttctctttttgatgaattttttcatcgagtattaattcgatggcaagttgtactttaggaaatagatcaagacattcttcttctgttaactcatgtatacctttgcttaaaattgcatatagctttctgttttcaacaagtatgcttggtaaataattcttaagtagcttaattttatgatccatttttgatccttcaaagtcgctattgttccaattagtactttgttctaatgcgatttgtctggtttcttcaattaagttttcaaagattctacgaagatatacaaatgaacctgcgccaatttcttgagaattcagtcgtattgccttagaaaaatctctatagtcgttctttaaaatggttttatactttttaatcttatgtaattgaaggtcagcaatagatggatattgtccaatctttgtaactttgttttgttgaatgagtaccgagaaatagaataaatgcaattcatccctgtggcatcggaatattaaagcgataggcaattgtgtttgtattctatctatagctttttctggatagtcatatatagtgagtggtttcaagccaccggtttgactatgaagattaaaagttgattcttttttacattcgatacagtaacaatcaaattgaattatttttggatttcttaaatatgattcaattatttcagcattctcatcattgatgattagggatcggtacagtcctaaatctaatggtaaaaaatctggggataaattatgactcaaataaaccagctccattcaattatttatcataattttaccacaagagtatgtgattggtattaagagtgcctgtgaatttgcttatcaataatataaaagaacgcctagcaatgaaaaatatagagattttaaaagggagaatagcaaattgagtaattgaagaaacgttaattatatttttcagtgtgtttgactcaattttcgcttttattattcagcatataattaaaggaggcaatgaaagacttgagactaaaagagattccaagtaaaattatagagaccttagacataggaaaagagcccatcgttttagttttttctgatggcacattgaaatatacacaattaccgccgcatggtgaaacaaaaattgtcactcacaataacaaagtgactcgattgatttttaacgaaggcgtactatttgaataaaaccgttctaccggaaagccgggggacactgatcatgacagcaaaaaagcgctgtgtgattggtgtcccttttttatattcagaaaagaaggacacgaggtgtaaatctatgtctaaaaaaagaactgacgtttctaagaagaaaagtacccaaaatcgcacgcaggagctttcagacaaagagataaatgcgctaatgggtatttccgccgaacatatagaagaggtagcggcggggctttaaaggataaataaagggggaggatattttatgttgggtgaaccacctgtaatagataaaaaagaaacgagaaaaagagttgaaagaattctcgacaactatcgtttgtatctccttcaagtcccggacgatatgctgccgaagataacaggaggattcagtatcgtgccgcccgccacaagcaacgctttccgctcatccacagaaagcacagctattaaacggattgaatgggagcagaaacgaaatacgtttcttgaaaaggtacaaagagcgatcaatcgtcttccgtataacgagaggcagatcattgtaaaacgttacatgcagcaagaacctgttttcgattaccaggtatataacgaaatcggcatgagtgaaagaacgtatacaaggttaaaagcaaagactttcctagacctggcttacgctctcaatgaagttgtgtttaaagcacccgtttagagatgtttttttgttcgacaaattttgcggattataaaattttataagtggaggtcgataaaagatgggggtgaaagaattgactagaaattataacgaagctaaaactacaataaaatatttagaaaaacgttatggtaaaaaattttataacttaactattgatggtcaaaaggaacttcaaagattaattattttagatcataataaagatgatttaaaaagaatgttgagaagaattaaagccgatattgagatagcgaaagatacacagtctattaatgtcttaccatttaatttttacatgataatgatcggtacgttaggttctgcgagcgttggaactatgtctctactttttatatttatgaacagtctttataataaatatttagaaactaaagattttagcaatgtagaggtatcagaattgacaaattttatagattttacattaattcttaggttaacgattattgctattggtataccttttttggtgatacttggtttatggtggtataaacataagaaattgacagataatgttgataagcgttacttcatttgtatattgctagaagaatgcctagaatttcataataatatatcacaacgagtagagccaacgaacagatattaagcagaatgacaaaagaaagcgcctttcacggtgctttttttattggcggaaaactggcgtgtttttggcgttatgttggcgaagcatgacagaaaaaaggttgtactattgtattatgtattagagaacgttttgaaaagaaaagagatcgttttttcgttcgacaaattctgcaactccttcaaattagccattttagttcgatattttaattgatatgttaaaagcattggaggagtccagttgagacaacaatttcgagagttttattttaataaagatgataacgatatttgggaagaatcaattattgtcttagatacaaatgttttattgaatttatataggtatactaaagaaacatcagatcagatcctaagtttattacaaaaatacgaaaaaaacctgtggatgcctcatcaagtggcgttggaatatcattataatagaaaatctgtaattttagaacagagtggttcatataagaaagtatgcgatacatttaatgatgtgcccgataaaattagaaatatgctgaatcaagatttgagtaattttaaaaagaggcacaaagatgatgtagatagtttcattaagattattaaagatattactaaagaacaaattaataaactaaaagatagaaatgatagcgaattggatttaacgaaaaaagatacaataaaaaataaaattactgatctatttttacataaagtaggtaaaccatatgaagaatctaaaatgaaaggtttagaaattgaagcagacgctcgtttaaaaaacaaaatacccccaggatataaagattatgataagaagaaaggtaataaatttcataacggtgttgtcatacaaaataaatacggtgatttaattctgtggaaacaattgctcgattttgcaagagacaatgaggttaatataattttcttaactgacgaacaaaaggaagattggtggtacgatataagcaataaaataattggaccaagaattgagttgttaaatgaattcactcatgtaactaataaagagtttcatatgtttagctcaattggctttgttgaaagacattcaagttattttaatgaaactgcagtttcggaagtaagagaggtaacaaccgagtacacaaacgcagaaaaattagcttttttaaataatcaattttctgataatagttcttatggaaaatttaataaacaattagacgctgctatgaggcttaaagaaaaaggtgtcaaaatgttgaacttattttcagaccttgaccaaaaaaatttatttgaagtaaaaactaatgaagaaatttatgagataataagcgaaagcttacatacgaaaatggagaaaagttcgtttctaagtttttgttattggtttaaagattatgattatacattcgatgaatttgaggaggaatatgaacgtttttatactaaagttaaaaatgaatttaatctatacattgctgataaaataatgaatattttatataggctaaacatagtcgagactgatccagcaaataacgcctgtattaatatgaatgaactgagaaatgttgtatatggttatctggtggaatatgacaaataatttaaatagtaaccctttttagtacccatttgggtgcttttttgtttgatttaaagtgctctacatgaataagtaaaggtgatgaatgatgccgctaaaaagatgtaatgcgtctgcctgccgagaatatatagattggaccgaacgctattgtatgaagcaccagggctatgctgataagcaatacaacaaagatgtgaggtacagcagggagaacgaagcgtactacaaatactatcaaagtagagaatggaaatcacttcgagaagcaaagaagcgtgagagtcattacagatgcgctgtatgtgccgcagaaggacgtgtaaacatgtccaataggttagtggtccatcataagcataaagagcttagagcggtatttcatgatgatatagagcgcaatgatttaaacaaccttgaggtgctttgtcagtttcatcataatcaaattacattttctaaaaaatgaattataattaacttaattccatttgagagggagagtatattgcgtaatgattggttggacctttttagacattatggtttagtaaaactaagtgattatgcggagcatgtagaaagcacattaaatcatcaacttgtcgaaattgatagatatattgatacatttgagaccacagaggaaaaagaattttatgttgatcgaatttatgatgaaatagcagcttatagtgatgacttcccagcaattatgagagcttcattgctgattagtatctattcttacttagaacatgaattaaataagttatgtcgatttcataacgaggaagggtttatgacatataaaaccaaagccactggcatagcacgatcaaaagagtttataaaaaaagaacttaagatgaattttcctgaccaaacaaaggagtggaatttcatttgtcatgtaaaagaaataagaaattgttttgcacatacacaggggtatatagatatgatgagtcaaagttcacaaagaagagttaggcaagcaattaaatcaataggaaaagatttaatttccgaaaaggagtctttaaaagaaattcagttacacgaaacgtttaataaagaatttataaaaaatgctgaaaaattcctcgactatatttatgaagaaataaagtccccccgacattaaacggggtgggcttttttgattcctggaaatcggcgtcccctcaactttaagaaaagtgttgaaatggagttttgatttttcccgttttttgcggtttttcactcattcataaaatggattgatcctttacaggcgttgagatagagctattttactcatttgtttgattgtcttaaattaataggttggattttgctgaaaggtggtggtttttattggcgagaagaaaacaattgacggacacattaaaagggcaaatatcgaatgaagaacgagagcagcgacagcagcatgaagaaaaattgaaaggcatatcgccattgaaagagaacccgccttattggctgtcaacaatggcaaaaaacgaatggatcagaatttaccctcatattatcgagctgccaatatcggaattggatcgcactttgttggctatgtactgtaatagttacgcacagtatcggcaggcattagaagatgtggcagcagagggacaagtcgtttttgaagtgaatagtaaggggtttgaagtgaaaaagaaaaacccgtctattgaaatcatgatgcaaatgtcgaaagagattcgagccattgcaggacaacttggtcttgcacttgatgctcgattacgtctagtcggtttaggtgaagagagcgaggatgacgatatatttgaggcaatgaggcaggatgacgacgattaaaaatgaccccggtactctttacgctgaaaaagtagtaaacggggaaattgtagcaactaaaaaagtcatccaggcatgcaaacgacatttgcgggatcttgaaaaatcaaaagaccctaactatccgtacgagtacaagcccaaaaaaggggcaaaggttgtaaagtttcttgaaatactgccggatatttcaacaggtaaacctacgtcactggcactctttcaaaaattcattgtctatatgatatttgcctggcgagacaaagaaacaggatatagacgatttacaaaagcatatatcagcatggcacgtaaaggcggtaaatccgttcttgtggctggtatagctttatatgaattgcttttcggtgatgcgcctagatacgatcgacagatttacacgacggctaattctcgtaaacaagcaaaagcggtttttaacatgattgtcatgcaacttaaaaagttgcggaagaaatcaaaacaaattaagaaaatgaccaagattattcaaaatgaaattcgttttttgctagaggatagcatcatcatgccgttatctcgtgatacagataaccttgacggcttaaatgtcttgattggcattcttgatgaatttcacacagcgacaaacacaaaaatgattgaggttttagagtcctcacaaggtcagcaagaccaggggcttatcttgatcattagtacagcgggttttaagctcaacggtcctatgtatgctcaagaatatccatatgtaacggatatattgagcgggaagaaagagaacgaaaactattttgcggttgtctatgagcaagatgatgaaaaagagataagcgacgagaacacctggattaaaagtaacccgttgcttgaagttgaaagcatgaaaaagaaattgctcaagaacttacgcaaaaaattgaaagaagcccaggaaaaagacgatctgaacggaacgcttgttaaaaactttaatttgtggcgttctgcctcttccgatagtttattgaacggtgacgattggaaagattgtgccgtcgaggaaaagccggatatatacgggaagcctgtctatatcggtgtggatttatccaggtcggaagatttatcttcattaggctttatttatcctttagaggatgccgaggaaaacttttatgttgatagtcattcgtttgttggtcgcaaaggcggtttagaaaacaagatacagcgtgacaaaattgactacaagcggcttgagcaagaagggtattgcacaataacagacaaagagtccggcatcattaatttacaacaagtgattgactacatggtcgatcacataacgaaaaatgatttgcaagtgaagggcatcttttatgatccatataacatttcattattcctaaatgaaattgaacattacggataccctgctattgaagtaaggcaaggggtaaggacgttatcagagccaacgaaaaactttagactcaatgtcatggatcaacgtctattgcatacaaacaacccattgctcaacctggcaataaacaatgccattttgaaaaaggtcaatgatacggtgcagatcgacaaggatttaaaccgggaaaaaattgacccaatcgctgccgttatgaatgcatatacagaggcaatgtaccattacgagcaaaacgaaacggattgggacgcctactatcaaagtgaagattttggaatatagaaggaggggaaagagtgccaaaacaatttaatcatctaattttaggagtatggcggttcttcatatcgaaccttcatactcttttgtttttgttagggctaatcctcatcaataccgccgtttatatggtcgggatgattttggggattgcggctagtggtattttgctagtctttgtcgccattcttctcaaccatgaaacagaaagggggtagagggaattggcgttctttagatcaatcaatcaacaaagcgcaggacaaagggaatttaacgaaattttggtgggcttagatggtttaagctatgtgccggcaacagctattaaaaatagtgatgtgttcacagcggttcacgtgttggcgtcagacatagcagcaagtccgatcatgattagaaacgaaggaatagaagaaaaggatagtgacttgtttcagcttatcaacgagcgccctaacgaatattactcggggtactcattcaaatatattcttgtcgccaatgcgcttttaaacggtcaatcgtttgcttatatcaaacgggataaagacggcacgccctgggagcttattcacatgttaaatagtgaagtctcggtagatcaaataaagggacggaacgatattgtttaccgttattacccttctgacggaaaagaagctattttgaaaccgtctgacgtgctgcatatcaagttttcctcactggatggggtaaacggaaagagcctcttatcatgtctcaagcacgaacttgaaagccaggaagcgggcaaaaggcttgtcacggacttttttagacgtggcacaaatttaagcggcattgtaacgcttaaaaaaggcgtaccgtcgcccgaagcaagggaaaacttgcgtaatgaatttgaaaaggtcaattcgggtgttaggaatcaacaaagaatagcggttttgagcgaaaacgaagaatttaagcagctagaaatcagtacaaaggttcttgagatcgtcaacaactacacgcattcaaccaaacaaattgcgaaagtgttcgggctgccgcctcataagttgggaatcgagcaagtgaacacttcactagaacaagcgaacctggattatttgacaaacaccctttcaaattactttgctgccattacagcggaattaaatttcaaaatgcttttttacccggaaagcaggaccaaacgttttcagtttgacgcaagacgttttaaggagacagacgctaaaacaaagcgggaaaatgtcattgcattacttcaaaacggtatttattcgcaaaatgacgcattagcagaatacggaatcgcgcctattgaaaatggaaataggcgctttatgagtttgaactatgtggatgttgacattatggacgaaatccaaaaagcaaaggcgaaggggcttccaattcctacggtcgataaagggggtgatgatattggagaaggagattagagccattcaggaaggttcactaaaagccacagaagaaaccgataaaggcagaatgatcacaggttatgcattgaaatttggtacacgcagccgaaacctgggcggctttatcgaaaccattgaaaaacgtgcgctgcaaaatgctgatatgtcagatgtaagggcgcttattgaccacgatccttctaaaattttgggaaggaccaaagccggaacactgaaactatctgtggatgatattggattgcgttttgaattgtctctacctaacacgcaatatgcaaacgatctatacgaaaacttgagacttggcaacatttcaaattgttcattcggttttcatcttgcgaaaaacggcgacagctttaaacgtgatgaaaaatcggggctgccgttgcggagcttaacgaatatttcacggattactgatgtttctatcgtcacttatccagcttatgaagatacagacgtatcaattgcacagcggcatttaaagcagcatcaaagcagccatttagaaaaagaaaaaatcaagttagagcttgatttaattgaattaagtatttagaaagtactcgtatattgcgggtgcttattttatttggaaaaggagcatgtacacatgttaaaagagaaaatccaggaattacgttcagagatcacaaagagacaaacggctatcaatacaaaaatcaaggaggctcatcaaagagcggaagaagacaagctagaagaagcaaaaacgattaaagatgaaatcacttctttaaaagcagagattgagacaatgacagaaaagctaaaagaattagaagaattggcaggaatgaaagcggaggaaatcacggaagcgggacaagccggaacagatgaacaaagatcacttccattagtcacaccgcatgtgcgcttggataaaggaattgaggaacagcgccgcagctttgaaacattcttgcgtactagaggtgaagtccgagacggtttgacaacagaaggagcagcggcaattattccgattgaagtcattacgacaccgcagaaaacgcccgaagatattgttgatctcgttgaatttgtgaataaagtcaacgtgacagcaccatccggttcatatccagttttagaaaatacagaaactgaacttgtttcagttgcggagcttgagaaaaaccccgatctagcaaacccaaaattcaataaaattgattggaaagttgaaacgtatcgtggtcaattggctatctctcaagaatcaattgatgattccggcgttgatttaacggcacttgtagcggatcatttgcaacaagtaaaacgaaacacaaggaatacaaaaattgcgggtgtcttaaaaacttttacagctaaaacagttacaggaacggacgacattaaaaagattttaaatgttgatttaaagcaagcatatgcccgtaatgttctttcgacgtcatccgcatttcaattcctagacacgctaaaagacaaaaacggtcaatacatcttgcaaagtaacatttcttcaccatccggcaaaacgctttttggaagcccgatcaaagttgttgatgatacattactcggcaaaaaagccggtgatatgaacatgtttatcggtgacttaaaacgagctgccttctttgccaatcgtgtagacgttgttgcaaagtgggttgaaaatgcggtgtatggtcaagtcctttcccttgctattcgtttcgacgtaaagcaagcagacaaaaacgcaggcttttatgtaacaatcaagccgccagttgaaacaggcgctacagaataggagtgaagaaatatgacccttgaagaattaaaacacgctttaaggatcactcatgacctggatgacaaaatgctagaaaccataaaagcagcggcagaaaaatttataaaagatagcgtcactttatcgaaagatagggacgctttttttattgataatccttgttttgatgatgcggtcatgatgctttgcggtcacaggtacgaaaaccgatcagcagtatcaaacaagaatctgcaagaagtgccgttcggcgttatgtcgtacattcaacaatttaaaggagaatacccttcatggactatggacgattaaatacgccgatctcttttgtgaaaaaggaaaatacaaaagaccctatatccagggagaacacgaccacattagaaagacttttcaccacctgggcggagcggagagatcaaaaattaagagaaaagctatcaacaaccggaacggttttagaggatagtttgacatatgttattcgctatcaacaagtatcgaccatttcaaacgctatgcacgtacaggatcacttgaccaacgagctttatcaagtcattgatattttgccaaacgagcaggacaaagacttgatcaatgtctttgtaaagaaggtgagctgatggcgcttgaagctaatggaatagaagaaacatataaagccattgaaaagatggctcgtcaaaatgtaaaagcggaaaaggctgccgttcatgctggcgcaaaactaatggcagatggcttggaaaagaacacgccatttgatagcaatagtggcaatgagaagcatttaaaatcagatgttttctattccaaaccaagagaggacggggaaatatattcaaccgttggctatggtaaggaaacggcttataggctacattttactaacttcggaacgatcaagcagcgcccgcaaagttttatcgagcgcacgatcaacgaatatgaacaactcgttttatcaaaaatgcaaagtgtttatagggggttgctcgggctatgatgctgccaattcaagaagtagaaatgattttgacaggatcgtccgatctgacaagctacgtcccggatgaaaaaatctatcttgtggacgtgccggagttagatcaaaaggtagatcaagccccgatgatccgtattaatgagcttgaaagctatcgtaatgcttatgaggatgatcaagcgacaggcataagcgttgatatacaaatagatttatggactgggacaatcaaggaagcacaagaaatacaaccgattattgatcgtttgatggcttcggctgattatcagcaatacgcttccgcatttgataaagacccggatatacaactgtacagatatgcacgaaggtacagagcaaataaagaaatagaaatcagtttttcatagagaggatgaattaaatggctacaacaggattgagagatattagagtcggcgtttttgaggatgacgccgccaaagaagcaaccgaagtaataaatgtacctggggcaatagaatcgaaattagaaccaagctcggaaattgcagtgctttatggtgatgatggcgtatttgatcaagaaggatcgggggttggtgaagcaaagctagaaatcggcgtggctgatcttacaactgaaatgaaaaacaaattgctaggagcggatgccattggcggatggcttgaagcatacggaaaagatactgacccgcctttcgttgctatcacattccggcagaaaacaaagggcggtttttggtatgttggacttttgcggggtaaattcggtattccgtctaatgaaggtaaaacaaaagaggataaagtcgaatttatcacgccaacaattgagggacaatttatgccccgtaaatctgatggtttaacctatgtcatggcgtatagtggaagccctggattcactgaaaaagccttttatgattttgtttttaaagggatcgcccctagcactgacggcgacaacggaacagcggaagcaccatcaagtaccacaacaaaaaaatagtgttttctgatagccaggtaatttattttacctggttaaactggattcattaaaaaatatacgaggtgtttaaaatgttgaaattaacaatgattgattcacaaacaaaagaagaaaaaacgtacacaaaagatatgccttcggctcgccaattaagacgtgcgcttgaattgcaagctcaaggtgaacaagaaaatttggacgcaacaacaatgcttgatgaaatgattgcctatgttgtggacgtattcgggaagcagttttcatatgatgactttttagacaatgtcccgtctgacgaaacatttcaaaccattgctgatgtcatcatgcaagtgacaggacaaaaaaagggaaacgacggcttgaaaaagaaagcggtgaaagcacagaaatagagcatttggaaacttggcaagattacctagattcattagatgatacttacgaagatttgatgaaagaagggtacaagtatcatgaaatagacaacatggacttgaacggatttttgcgtcttgcgaatcgaaaaggacaaagcgagggcagcgttccaatagatcagattttaagaccaggaggcttttgagccttcttttatttttgaggaaaggaggtaaaccatatggcaacggaagggcgtccgataggttctttagtcgttaatacgacgttagatagtacagggtttgacaaaggcgtcacagccttgaggcagcagcttaaaacggcacagtccgcaaccaaagcaaccgcagccgaatttaaagcattagatgacaagctgggagaaagtaaaagtaaggtatcgggcttatcagatcaattaaagattcaagaaagaatcgtagactcttatcgtcaagcatacgaaaagcaagtggagcaatacggcgagggatcaacccaggcgcagaagtacgcacaacgtttaaactctcaaataacaagctatcgcaacatgcaaaatgctttaaggcttgcacaaagtcaggttgaacggcttgagcgtgccgaatcagaagcagcaaacagcgccgacgatttagcaacaagtcatcaaaatgtatctaatgatgtaacggcagcgggtaaagaggtttccaaactctcaagcattttaaagggcggatttgctacggcagcggtagcgggtacggtagccattggagcattaacggcagccgttggcacgcttggcgcaaaaatgacggctgatattcaagcgtctcaaggtcgtttaagagcgcagctaggtttaacaggcgatgaagccaaaaggctcacaggcatagcaaaagacgtgtgggcacagggcttcggagagaatttggatgacgctaggaatggtctgtttcaaattaaacaaaatatccgaggcattgcagacaaggaccttacggacgtaacgaaaaaagccctggtgcttgctgatgcttttgattccgaggtaaacgaagtggcgagagcaggcaacaaccttatgaaaggttttggcgtgactgtgagtgatgcgtttgatctcatgacgtatggcgcacaaaacggattgaatttttccaacgagatgttcgacaacctatccgagtattcaacgttattcggaaaaatgggttattcagcacaagaatattttcaattactcgtcaacggaacaaaagcgggcgtttacaacctggattacgtcaacgacgtcatgaaagagtttcaaattcgtgtcaaggatggctcgaaatcgactaatgaagcaatggcgagtatgtctaaaccgacacaaaaggtatggcaagaatttttaaaaggtaaagggaccgtcaaggatgtatcaaacaccgttttaaaagagcttaaaggcatgaaagaccaggtggacgctaacaatatcggcgtggctcttttcgggacaaaatgggaggacttagaggctgacgccatgtatgccctgggcggcattgatggaaaaatcggtgacgtaaagggcaaagctgacgaagcaggggcagcattgcaagacaatctaggcacacgctttaaaaagatcgggcgtcaagcactgtcagcgctagagccgttaggaggcgcggcggctacaatgcttgaaaaagcctttaatattgctgatccaatcatgaaagaaatgtccagcgctggcaataccgtaaaacaggcaatggcgggtatttggggcataatgcaaggcgagggaagcgctgaaagattagaaggatacggcatattatcgcagtttttcccgcctggcgtggttgatatgattgtaaacactactgatacagtaaaaggtgtgattgatagtataaaaagctcgtttcaaagtatgcagccgacctttcaagcgattggcggcattttgatgaatgtatttgtcacaatggcgccgattgtaaaacaagcccttggcggaatcttgtcatttatcggacagcttgccacagtgtgggggacgttttggaaggaaaacggcggtgtgattacacaagccttacaaaatatatggtctgtggtccaattcgtcatgcctgccattattgccattattaaaagcgtttggggcaatattaaaggcgttgtcatgggcgcaatgcaagtgattcaaggtgttatacaattcttctcgggcttgctgacgggagatttcggcaagatgtgggaaggtattaaaaatgtgttttttggttctatcaatgcgcttttgaattttgttcaactgtccttttttgggaagattcttgggattgcgaaatcactaggaaaagggcttttaggcatcttcccgaaaatgtggtctagcattgtcggtttctttaaaaatggtgctgcaaacaccggaaaaatggtcacttggcttaaagacaaagccgtttcaattgcaacaagcatgaaagacggcatgatcaaacgtttttgggacattgtagacgcagccaaaaaattgccgggtaaaatcggtaatggcattaaaagtatggcgtgggctgcgcttaaaggtgtcaagtcgcttgcggataaaatgaataacaaactatcctttgtcgtaaatggggtaataggtggcgttaactgggttcttggtaaagtcggtgttccgaaagaaaatcaaataccggaatggacaccgccaaaatacgcaaaagggacaggcggacacccaggaggacccgccattctaggcgacggaggaatgcaagaactgtttatcacgcctggcggtcaaatggggctgtctccttcaactgatacaatgatgaaccttccaaaaggaaccgaggtattgtcgggacctaaaacgaaagcgttatttgatgacgtaccattttacaaagatggtacaggcaagggcggtaacttcatttctagtctttttggtaaagtgaaagacctggtacttgatgtgtctgacttcattacaaagcctagcaagctaatgaatacattgcttcaaaaaatggggatcacgcccccgagtatggcagggggctttggtcagattgtcaaaggcagcttttcttttattaaggacaaagcggtttcctttattaaaaacaagatcaaagactttggttttgttcctggggagggaggcagcgcagcagttaaaaagtgggtcgcccaagcaattgcgataaagggaatttccccctctttttcaaaagcgcttgaaacgatcgccatgaaagaatcgggcggaaaccctacagtcgtaaataattgggacagcaacgcaaaagcggggcatccgtcccaagggcttatgcaattcattccgtctacttttgcagcgaacaaagaacctggttacggaaatattaaaaaccctgtacaccaggttattgcggctatcaactatttgaatagtcggtatggcggaattaacaagcacccgggcttggtcaacatgagaaaaggaggcaagtacattggctatgataaaggcggtatcattacccgaaatcatacggcagaggtccacaaaggggaaatgattttacctttaaggcaattcagaagaaaccgagccatgcaggtacttgctcaagctaatcgaatggtaggctatcagcccgagcagccgggacaaggttcaacaaatgtcattgttcaaaatgatagtgctgatgctattaagcaactagaaaacaagtttgatcaaatgatcggtttgttgacacagatcgccatgaaagacaccacgataaatgttgagggactaaacaagtacaatatggatttacttaaaaatagacagcgtaggggagggcttgcgacatgagttacgaattttatacggattacggggaagggcttcaattgatcagcgagcgtcttccctttttacgttgcgtaaaatttacgcctgtgtcggcttctatcgaacgtcaaacggcggttgtggcaaatagaccaggattaaaacaaacgtcgaaaaaagtccgttttaaagaaagaaaaatcaaagcacgattttatattaaagcaaaaagcacggatcagtttaatagatacagggcggcgctcacaagggagcttgtaagggaagaaccctattacattagttgttctttttcgcctggtatacgctacctggtgacgtgtgatgatgaaattgaaatcgaaaaagatgacgggaaaaattataaagaagttgatgtggaatttaccgcagcgcttgggcttggcgaaaccgtttttaatactgaaaaacccttgaatttaagtggtgaaaattttcatatcggcatgaatttgccgagtcaagatgatctgaaataccgtttcacatccaagacgttcaaagtctacaacgcttctgatgtgacaattgatccgattgactttgattatagcgtcaccatgtatttaacaggtaaggacgtgaagatacgtaatgatgccacaaaagaggcgttaacgataaggggatcggtttcgaaaaagcaaaaaatcattatcacacgtcaatatgtcatgattgatgggaaaatggcggacacgtccgggcgctttccgagtttgcgccctggttttaatctatttgagatcgaaggcgcatctagtattgatatgcggtttgccttgcgcttttactataagtaggtgaaatgatgaatcaattatttgtacagtcaaagcatgatccaacaaataaagtacctttggaacatgtagaacccgaagtctcggacaaattagacggcacaaagcaattgtcatttcaatgtttgcaaatgcccgagactgaaattgctttcgatatacttgtaaatgacaacattttgctaatagatgagattgagcataaagcgcagcgttatatcattgttgaggatgaaaagcgcacagaaaacggcgtgtcattccgaaatgtggtggctgatcatatgtatattgttcgtctgacatataaccaggtggatgaagaaattaacggagaaatagatatagacacagcgcttaaacacgtattaaaaggaagcggctttgcatatacgatcatgccggatgctaaaggcttgaaagccaaactagaaggattcggaaagaagaagtcgttagagctgatgaacgatcttatatcggcttttgttgttgaacttgatgtaaataatgatcatatttacgtattcaaagaaatcaaaaagcggatcaattacaaattagataccagggcgaatatgaatacgattagtgttaaaagcagcttgtccgagtcttacacacgaataaagggttatggaaaggtgaaggaagaaaaggacacagcaagcgaggaaacaaaaagctatgatagtaaatcgtcgaaatggaaaacaaacagtgatttaaatgccatgtatgcggaggacgttggacaaacgttctcttttacgtttaaagggacaggcttcagcgtgaagctgatcaaagaaaaattaggcgggaaaatcacgttcaatatagataaaaagacaaacaaaacattcagcacgtacaaagacacaggcaaagaaagtcatgtggttgaaacggttgatgtgatccggggtcttgaggataaagagcatacggtcgttgctacattcaaaggaaaagatagcaaaaacccgaacacgaaaaaaatgaaaacgggtttccgtgtgagcgtgcctaacgggaattttattggactttatcggacctttaaaaatgatgaaaagtacatgttcccgcctgtaacttatattcaccccgacgaaaaacttttccttgtagatggtcgcccgagagtagcggaaacagtttacgaggattccatttcaaaaaaagaggacatggaaaaatttttggaaaagaaagttgacccttatccaaaattaacgatcgaattggattttgaaaaagtatatgatccgaaactcgaagcgattgaggacaacatttgtaaaggtgctattgttccagtcattgcagatacagcatacggcatcctgtttgaaggagaggtaagggtacaggaaatcaaatacaaccctctcaatttggatatgaagccgtctgtcacgctgacgaattatcgtaaagacattattgactatcaactagagcagaccgtcgcaatgaagaagcaacgggatttaatcaagaaagaaatagccgaaatgcttgaggcgcaaaaaagcatagcaagcagcacgcaaagccaattgaacaatattaatacaaaggtttcccaggacttgagcttatcgtattcaaccgtcacgaaaacttggtcaattgatgatagcagcgttgatggtgcggaaattgacgagatagggaacaccattgatatagatgttgggatcgacataaaaccaaaaagccccagggcgggcgttgattttgatttaagtctaaaggggatcacggcaggcgcaaccattgatacgaccaacccaagcgccatgaatattgtgcttgctaaagacggtcaaaggatcagcccaacggctgccgatataccaaacggcgcacaaattaatatttcattttacttagatagctgacgatcaaacgtcggctattttttatgaaaggagctgatagcatgggaaggttcaatttattgaaagtctttaaaattggcagaaatgcagagtttgaagacaacctatcgcaaaatgcaagatcaatagaaaacgctttgaaccaactagacatagaaatcaaagaacataaagggagcgaaaaagctcacgaagcggcaagcatcgtccacagagggaaaagcgttgcacactggctcaatagttattggtcccgtcttgttaatctgatcgtcaatcatgatggcaacgatataaaagaagttgtggacggaagggtttcgcttgatgcgaccattcatccgactttgaatgatcgtcttgaatatgactttgatcagcttgaaaagaaagtgaatgacatgctttcggttgtgtctttgcagccgtttttaaacaaatacggcaacttcacaaaggctttacaagcagcgttagaaatagcaaaagatcgccccatttggctttatattcccccagggggctatacgctgcgggaacgggtgaggatttacaaaaacactcatattactttacaggcaggggcaacgatcaagcgtggctttgttggcagcatgtttgtaaatggtgattcaaatgagagtttcaccgggtacaacgggcacggcaacttgatcattgacggacaaggaacaatcgacagcatgggacacgagatcaagcaacagtgttctatttttgggttcgctcatgcatccggcattatcatgcgagatctcacattgagaaatgtttgtgggggacacgctcttgattgtgcgggcaatgaaaacgtgatgatcgacaatgtgacattcgaagggtttgcggactatgtaggggacagatggttttccgcagcggttcaagttgatttgatgagatcatccggcaattttggcgcttttggagcttatgatcacacaccgacaagaaaccttacaatgaaaaattgtactatccgtaaatcagcagagcttgggggctatccgagagcgattgattcacatacaagcactgacggcgtcctatactcgggcataaggtttattaacaataaggtctatgactgtacagaatgggcggtatcgggcaacaaatggcaagatgtgttcattgatggcaattcctttgaaaactgttcaggtggcgttagaacgttattgcctggaccaaacagcgtttatacacaggataaaaacggaaatcaaacagggcgtgttaataagacaaagcgtcacacaattacaaacaacaaatttaaaaacatgtcggctgaccatgcaatccaggtttacggtcgtaaagggtatcaaaccattgatcttgtggtcatttcaaaaaatcaaattgacggcacaaccaggcacggtatccatgtttcagatgtaaagcattttgttattgatgataatatcctagaaaatatcgggcatcatggcattttagttacccgcagcactcggggaaaagttcaccacaacacaggacgagaaattcaaggaaacggtgtgcgaatcgaggagggaagttgcgattttgtttctgtggatgataacacgctagaagaaatcgggttttcgggaatatccgtctcgggtgattctgattacgtacaggtagatgaaaacacgatcatgaatgcgggcaagcgtggtgatgattacgattttattttatttatggatggcgtgaaaaatagcgccgttcgtaataatacagcaattgggaaaacgggaaggtacggtatgtatttaacaagcaaatgttcagctattcagcattacggtaaccgattaaaaggagccggaaaagtatctgcattaaacgataaaagcgttgatcctattcgtaccgttgaaaatatcacttgaggggggataacatgacgaatcaactttttaaaaatggcgtgctgcctttcgtggttgatgcctatgatcaaagcgtgtacgattcaaaaattattttctcaacccaggacataggcacagcaaagctaattttcaaattgcgtaaagatggcgtgcctttgcctctttcagcggttgacggaaaactcatactatcattcaacaatggatccaagaacgttcggaatatcacacttgttgataaagtagaagggattgccgaatacgtcttagacaataacgagattaagctatacggtaaggtccaagcgtcattaaatttgtattatcgtaacggacaagccttgtcgattcacgaatttacatttgagattcagcgcaatttaattgaccaggacattgccccagcagcggaattttatattgatgattttcattctcttaaaatcgaaatagaacgtaaagcagcgcagcttgaagcggatataaaaaagcgaactgacgatatgcaaggaaacattgataagatcaccaaagagcttcaagagcagcttgacaggatgaaagagaaacttgacgatctcgaagcgcttgaaaccaaacaaggcgcacaaggtaaagtagacgcagcgcttgcagcggctaaaaagtatacggaggattacgcagagacacccgcaaaggctcaagaaaaagcagatgaagtcttgaagaaggcgaaagactttgtctcgggttttcaacaaaagaaaattacggctgatacaggaatgccgttgatctctctaaaagatacatccaagagcattcttgaggaaattatcaataatggagtagggcaaggaactttttacgcaattgccagttcaaaagatttaccgaatcagcgttctttccgaggtttctatcatatgactgattccacgaacggcgtcgcctctttcggatgggtatacgcaaccgactatgtaaataacgtctacacaaactatttaaataataatgtatggagtggttggtcaaggttgtctaatcacaatttgctgtctgaaaccggacaaagccagttgcttccgaacggtacggacattttaacactgccttccggttgttattatgccgttggaacaaatgtcgtgaatatgccgagtaaaaccgattcatcttggttcaatatttatataattgataacggcaacaaccgaaaaacgttccatattatccgaagtggagataatctccattggtggggaacgactcatacggacggatcgttcagaggatggaaacggatgctgacggatgatgattcaagtggaacatggaaccaagtaacgttaatcgctggaacatcaacaaaacaatttgcaggaaatccactcaaattttcaattcgtcaaaatgatttactacttagggggtcttttgagggagtcccggcaaatgacgcagtcattgcccgttttactcaaaaaccgccaacaaaagccgtgtttctcggtgcgacggtgggttcttatggttctgctagatttacacttgatacagacggcgctttacgttttgacgggatgtccgctaacgataattcttttgtaagtagatttgaaataaatgaatgtatcccattgttttaggaggtaattacatgcacatttattactatgatgagaagtttaaatatcaaggtgaagatgtaattgattatgacgagctgccgaaaaatgctacggatgcaagaccgcaagaggggttgtatcttcccgagtatgacgagaaaaaaagagtgtggtttgaatcagcatctaaagagtatatagagagcttacaaccaaagccgcagccgtcaaaaatagacctcatggagaaacaagttgccgagctttattacttgtttgcattagggggtgatccatcgtgagtgatttcgattggttcagcagaatcaaagatttttatgatagagaattatggtcaaaagaaatggtttataacactgtagcagcggggagaatcacacacgaacaatatgaggaaatcacaggtgagccgtacgaagtataggcttattttttatgtttatggcgggagaaggtgagagtgatggaaatggatattgcgcagtatttaatgacacaaggaccgtttgcggttttgttttgttgggtgttgttttatgtcctcaatacaactaaagagcgtgagaacaagctaaacgagcaaatagacgcacaaaatgacatattagcaaaattcagtgagaaatacgacgttgtaatctcgaaattggaccgtattgaaagaaaccaaaaacaataagaaaagaggaatttttgatatgaaaaactttgacaaaggcacggtcgttcgcacggtgcttctttttattgcactaatcaaccaggcgctaatcatgtttggcaaacctgttttgccgatcagtgaggaccaggtaaacacattaacagaaactttataccttgccttctcaatggtctttacgttagtgacaacccttgtcgcatggttcaaaaataactatgtgacaagtcgagggaaagcccaaaaagaagcgctgcaacaaaaaggattaacaaaataaagggctgccccaggcagttcttttttaatacctaaaataattttaagggagtagatgaacaatggtaaaaatcattcaagactatatttcaaagagtaaccgcaacagaccaggcaactatatgaagcctttatatattacagttcataacacgtctaacacgtcaaagggcgcagacgcagcaagtcacgctagttttgtgaaacgttcatccacggcggtgagctggcattacactgtggacgaaaatgtaatctatcagcacttaccactaaacgaaaacggatggcacgcaggagatggcagaggaacgggcaacatgaagtcaatcggcatcgaaatttgtgaaaatgcagatggtaattttgagaaggcggtagagaatgctcaatggttgattcgccaattaatgacggatcaaggcattccattgtcaaacgttgtaccgcataagcattggagtgggaaagaatgtccccgcaggttgcttgatcgttgggacagcttcaaaggcggtatcgccgttgctcacataaataaaaagccgtctgctaaaccaacaaaagcaacaccatccaaaacagcggcttccaagcctgctaaaaagtcatatggtttgccagcaggcattttaaaagttacaaagcctcttacaaagggatcagcagtaaaagccgtacagcaagccctagcggcggtttactactacccggacaaaggagcaaaaaacaacggtgttgatggctattacggaccgaaaacagcggatgcggtcaagcgattccaattgatgcatggacttgctgctgacggcctttatggtccaaagactaaagcagctttagaaaagctattaaaataaaaatctatagacttatgactatagatagttttaaaacaagaaacccccctgtccattattggatggggggttttacttatatagaatttattttaatcttccccatatagctcttccgcctgtatgtcctgttttcttgtgaatttctttgttcacaagttgtaatcttcctgtgttttcatggtgatgccaaacatagcctctaggggttttgttatggtttatatcaatgatttggttcttagtaaattttttagcatgtttaggtgacttaataccgatttttaaagatgcgttcgccttagcgaattgagttttgttagatgactttattaacaaacctggtagattgtaattgaattttgaattgaaaacagggaagccatttgcagtgaatttaacaccggttttagggtgtttctttttagcaagttttccatttctgattacaacttttttcgttgagtttttcaaatattgttttgcatatagtttcccaccgattcgcataacaacaggaaaagcaagaggaactaaccaaaaagggtaagcttgaataatatcaacgtcatcgtctgtaccaattgcatcggctggagcagaaaacgatggttctactaattcccctttttcaaaaacatcatcagaaattgtatctttttctagctcctcatctgtaacatcatcttcaagtaaaccttgatactcttcatagttatcccaatcctcatattcttgagcatatggaaaatcatcatagttttcgtaagaagattcaatgtagtcgtttaattgatcttccgttaaattactttctctaacttgtgctgattccgcttttgcaaactccggtaaaataaaagatactagaagcaatagcggtaatgttgtacataaaaacttccttaatttcaattaaagcacctcttttgtattatatttacaaacattgcaagtataatacaagtattggaggtaaacaatacctattctataaaatcttccaattgattaacaataatctcaacatctgaatcatttaatctatttaagttactaatgatacttttaaatgtttccagtgattctttgttctctaaaatcaagtttttcttgtatgttgctactgtatctagcactaaccccaattcaagagcgccatcaacgtcattcgttgaatgagtatgagtttctatttttttcaataaccaaatgagatcgtcataattttgaatagggaagagcttgagattagaaaataattcttcattatttttttcaaatatcctatttacttcatcctttgtaattgcgtctggatcgtcgggcgatatatatgtaagttcatagtcctcggggtctaacccttctaaatcaggttcactatcatctgattcatcaatatagagttttgaaataaattcattaaaactatctgctattttaaagtcctcttctgtttctaaatcgaaaaaatgaacgggtggattctctatggtatttcggtaatccagtgcgacccaggaatgaccatcacccgagataagaataatatctttaggaagcccccattcttttattaaatagtcactttctaaaatcccttctttttttccgatccctagcaaatgatcaaattgtatatgatcctctgcccaggaagtaggtctatccgtagggaaagcattacattctaaataaccgccattttgctccaagactaagtttttatattcttgtggcagcttaactcctagctttttttctgttttcagaatatctttttcagatattttttttaaagtatatggatcgtctgattggttagcccaaaattgtttcaactcatcatctcctaaaatatagatatacttttaaattataccttcgactcaaagtcttatcaatagacttaaaaaactaaaagaatgaaaaaaattgcggtttgttttcggtgtggaaatatttcaaaaatgataatatatgtaattatagggaatagcaaggaaggggtagggtcttatggagaaagttctttcttctcatgtcgggttgaaaatcaatgaatggtattaccatattcaaagatttaacgtgccggatgccgaagcatataaagaagaaataaaatctttgctcgatgatatggaggaaaaccaggatttattattatatttctctctcatggaattccgacataaattaatgttggattatttgaatccattggaaaatggaaaagagcgtgccgactttagagagttagcaatgaagatcaaaaaggatcaagagaaattaacgggtttacttgattattattttaactttttctatggcatgtacgaatttgaaaactatgaatacctcaacgcaattaccttctataaacgagcagaaaagaagttatccttagtaagtgacgatattgaacgagccgagtttaatttcaagatagcggaaatctattaccacatgaaacaaaaccacatgtctatgcaccatatagcccaagcaatagattgttacaaagaaaaaaacacttatactgttaggcagatacagtgttcttttgttattggattaaattatattgatatgggttgccccgaaaaagcaatgcctcattttgaatacgcactagaaaaatcttccgacaacgcaacaaaaagattaaaaggatcggcgctttataatataggattaagttatttccacaatgatgaactattaatggctataaaatactttaacgaatcaatccattcatttaaagaacaaggatacgaacatttaaataaaattcttgatccgatggttatgttgacaaagtcatactttaaaactgatcaaaatgacttagggttatacgccttaaacgagggaatagaattggctggaaaattgaaagacgacatatttataaatacattcactctattgagatcattgtatttagaaaacaatgttagtcttttaaaagaagcaatggcttatttagaatcaaaatttctttatgcgaatcttgaagatttatcgaaagatgcggcgaagcattataataaggcaggagataaagagcgtgcaaacgaattttatgagaagattctttatttccaactccaaattaagagaggggactgtctttatgaaatttaagtcagtagcagccgtattaattattgtaagtttgttaggtgcttttagttatgtttcatcaaacgatatccataatgaagcccaacggggacatacaacaagtattggttattttgcttaattaaaaaagcccttttcgggggcttctttttatttgaaccgccattccttcttttccttatcccatgtcaattcatttcttgttaacggcttttcgtatagattgttcgtctttacctgtttttatttttaagtcctccattgtggggttcttgcggaatctgctcatattatatatgatcctgtatagcttcctctcaagatcattcatgaaatcaccaccgtgacctattttatttgaatatctttttcattagcttgccgcttgctttacccgcagcacgtcgcatgatacgtttttcgatagtacccttttgaacggcattgacgtcacccaggtattttgatgtcttataaaggaatgatcttattttgtttatgttcatggggtatgcacctactttcttcattaatatagagttatgtgggcttgcccactaaatgcccactaattgatgacaaactataaagtggtatgatgtaagaataatataaaacgcaggaaagacaacaacaagggaatatatgttcttgtgtgatttcctgcaaataattttttcttctaatagcatcatgatataagctgggaacttctcttcggcaatctccatgtagcgctcaatcatgacgtaatcatcactaatgtattgagacagtagctcgtaccaccattcagtttcgtagcgggcaatcatactaaggttatacattaataagtaatggctgatgacctcaggaatccctaaaaaggaatcacgcgttgacggaatataccattgatccatttctaaatcataatgaagatgagtggcgagcgctggattttcttctagtgatacatcaaatgtcagctttttcgcttctctctgtctgagtttccaacttgtatgaaactcaaaatattcaataaagcgttcagcagacatgttataaagcaatggaatatgatcttgaatcatcatcccattggccttttccaccttaactaatgtagagggctgtttttgaaactctagaatatgactcatttccggtatctttgaaaggagatgaatcatcgtaaatcgctcatcttcaagtccatttaaatgaaatagatgctttaacacatgcatgcatagtccatttcgctgaattttcacctcatcttcactaaaacggtaatgctgcttctttctctttctcgatgttacaccatgcgctaaaacagaggtttgagaaggatagtgagggtcaactgtcagtaaacatgcctttagcaactgagccattccataaaacaataaaatgggcttcagttcgagtggagcgatagctgcctgttcatagaacgtatgaccatgctttaaaaaataaataaaccgttcacagtttttataggcttgctggtttgcatcttgaatgctctgtttctcatattgttgatatagaaacttttgggaagtttcgagtgagtaaaaacgttttaaatccttccatcctgaacttttcatcttcttcctcaactctctttatattttctaaaaattgcaactgtttgttgcttccttgacatgctgtttgctagttgataatctacatataatattttgccgaaaagagggggatttactaatgtgggaaagtaaattttcaaaagaaggtttgacgtttgacgatgttttgcttgttccagctaagtctgaagtacttccgcgagatgtcgatttatcagttgagttaacaagcacattaaaactaaacattccaattatcagtgcaggaatggacacggtgactgaatcacaaatggcgattgcaatggcacgtcaaggtggtcttggtatcattcataagaacatgtctattgagcaacaagcagagcaagtggataaagtaaaacgttcagagcgtggcgttattacaaatccattcttcttaacacctgagcatcaagtatttgatgcagagcacctaatgggtaagtaccgtatttcaggtgtaccaatcgtaaataacatagaagatcaaaagcttgtcggtattattacgaaccgtgaccttcgatttatttcggattattcaatgaagattagcgatgtgatgacaaaagaggaacttgtgacagcttctgtaggtacgacgctagaagaagctgaaaaaattctacagcaatataaaattgaaaaattacctcttttagatgacgaaggaacgttaaaaggtctcatcaccatcaaagatattgaaaaagtgatcgaattccctaactcctctaaagatgcacatggccgtttaattgttggtgccgctgttggtgtcactggcgatacaatgactcgtgtaagaaaattagtcgaagccaatgtggatgtcgttgtcattgatacggcacatggtcattcacaaggtgttctaaacactgtatcgaaaatccgtgaaacatatccttctcttaatatcattgctggtaatgttgcaacagccgaagcaactaaagcattgtttgaagcaggagcagatattgtgaaagtcggtatcggaccaggatctatttgtacaacacgtgttgttgcaggcgttggtgtaccacaaatcacagcgatctatgattgtgcaacagaagcaagaaaacacggtaaagctattattgcagatggtggaattaaatattcaggtgatatcgtaaaagctctagcatctggtggacatgctgtaatgcttggaagccttctagctggtacatctgaaagcccaggagacacagaaattttccaaggtagacgcttcaaagtatatcgcggtatgggctcagtcgctgcaatggaaaaaggaagtaaagatcgttacttccaagaagataataaaaaattcgttccagaaggtattgaaggccgtacaccatacaaaggaccagttgttgatacagtgtatcaactcgttggcggtatccgctctggtatgggctattgtggaacacaggacttacgctctcttagagaagatgcacagttcattcgaatgactggtgcagggcttcgtgagagtcatccacatgatgtacaaattacaaaagaatcaccaaactacacaatttcttgataaattgtgacaatcaaattacatttgacagggtctatgactctgtctattttttttgtctttattgtgataaaatttatactgttgtgttgaaataagcccttgtggattaaatatatatgaaatatgtcgaaaaagatgataacggaggtatgacgattgaacagcaagatattgaaacagcttatggtctctatccttgcattggcattgattgtgacagcatttacaccaatgtccaaagcaaaagcagctgaagatccattcaatgtgaatgcgaaagcagcgatcctaattgaagcttctacaggtaagatcctttatagtaagaacgcagaacaaagactgcctattgcaagtatggcaaagatgatgacagagtatctattactagaggcgattgctgaaggcaaagtgaaatgggatcaaacgtatacgccagatgattatgtatacgaaatttctcaggaccgcagtttatctaatgttcctttgagaaaagatggctcgtatacagtgaaagaactttatcaagcaacggctatttattcggcaaatgcagcagcaattggcttagcagaagtgattgctggatcagaatcgaagttcgttgaaaaaatgaatgcaaaagcgaaagaactaggtttaacaaattacaaattcgtgaatgcaactggactagaaaataaagacttacatggcaaacagccaaagggtacaggtcctgatgaagaaagtgaagtatctgcgaaagatatggcattgcttgcacagcatctcatcaaagaccatccagaaatccttgaaacatcaagtattgcgaaaacaaagttcagagaaggcacagacgatgaaatggacatgcctaactggaacttcatgcttaaaggacttgtgaaggaatatgaaggtgtagacggcttaaagacaggttctacagattcagctggttctagcttcacaggtaccgctaaacaaggtgacatgcgtgtcatcgcagtgatcttgaatgcaaaaggtaatcttcatacagcacggttcgacgtggcgaaaaaactgttcgattatgcgtttaaaaacttcacgatgaaagaaatgtacaaaaaaggtcaacagatcaaaggacatgaaaacatcgaagtcgacaaaggcaaagacaaagaagtacctgtcgttacgaaagaagctttctctgtgccagtcaaaaatggcgacgaaaagagcttcaaagcaaaagtaaatatcgagaaaacgaaactagaagctcctatgaaaaaaggaacgaaggttggcatgctgacgacttcttattcaggtgatgagaaggactacggctatttgaataaagatcaatcaggtgttgagcttataacgaaaacaggcgatgaaaaagcaaactggttcatccttgcaatgcgtagtgtaggtggattcttcgctggcatttggggcggaatcgttgacacagtaaaaggttggttctaataaaaactgctctctatatatgagagcagttttttatcgttaaaagaaaagcgattgtttgtgattttgaggagtggacaaggcttgctgaaaaataccacataatttttccacgccttcagatagcgctttttcattcacataagaaaagctgaggcggatatagttttgcttcggctccccaggatagcacacagagccaggcagaaaggtgatttgctgtttgcgtgcctcatgcagcagtgcacgtgtatcaacccaggaaggaaagctaagccataaattgagcccaccctgagggatttgccacgtcacatcttttggtgcatgcttcgttaacacatctatcattaaatcacgtctcaccttcaaggcggttcgtagcttttttgtatgatcaatcattttctttgaagtcagaaatggcagaatggctttttgtgtgagaagagggctgcctaaatcattattggcctttgcagctaataaacgattaaatatcgagcctgaagcagtaataatcccaattctgcatcctggagcaagtgttttacttaaaccgcgtaaataaatgacatgtccatcatgatccagacttttaataggtgcaggcggcttcttttcgaaatatagctcacgataaggatcatcctctacaatgagacaatcaatactttgagccagtaagagaagttgttttctgcgtttcattgacatacttgcgcctgtcggactgtgaaaagtaggaatcgtgtagatgagctttggtttatacttatcacaaatgctttgaagctgcttcatgttcattccttcatgatcaacagggactgtaataattcttgcccctctacccataaagacatcaatggcacctggataggttggtgcttccatgacaactacatcatcaggaccgataaacgcacgtgcgaccaaatcaagtccttgctgagaaccactagttactaagatattctcaggagtagatggcacatccaacttttctaaaaaagactgaatgacttgccgaagctgaagatccccttgaatttccccatacttagacatgatttgaggatgtctggctaggacatgctgcatttccttttctaaataccggtttggcaaaagccctggatcgatcatagaggaagaaaggttgatcgcttcttcgacatagtgatactgagcaaattgagatcgtggtaaataatccggaatggataactgccagtcaaaagaggtagatgacggaaccggaacatctgactgcttttgcagctcatccacaaacgtaccttttccttgcacagtcgttaaatatccgtcgtccttcagccgagtgtatgcctttgctgccgtgacaagactcacattcagctgctttgctaaatcacgaacagttggcagcttatctccttgttgaagcaaacccgattggatatgatcaatgattgaaaagtaaatctgatttgaaagcgatgtatcagaatgtcgatggatatcaatatgcatgagaaacctccattgagtgcaaaattgttatacatggatttgaattgttatagttgtattatagcatgtaaatgacacttcaaagaaagaatgacatatttttagcaggtaatcgtttatatacaagggtttaagcttttttttcggctgattgaattgttatactattctctttattgttatactgtctcgcttgtatgataaaggggtaaatcaatcgaattgacaaatgggaggaaactattgtgagcaataagggaactgaacgagtgaaacgtggaatggcagaaatgcaaaagggtggcgtcattatggatgtcgtcaatgctgaacaggcaaagattgcagaagaagcaggtgcggtggcagttatggcactagaacgcgtaccagctgatatccgtgcagccggcggtgttgcccgtatggcagacccaagaatcgtagaagaagtacaaaatgcagtaacgattccagtcatggcaaaagctcgtatcggccatatcgtcgaggctcgtgttcttgaagcacttggtgttgattatattgatgagagtgaagtgctgacgcccgcagatgaggagttccatttaaataaaaatgaatacacagtacctttcgtttgtggttgccgtgatttaggtgaagcaacccgtcgtattgcagaaggcgcttctatgcttcgtacaaaaggagagcctgggacaggcaacattgtagaagctgtccgtcatatgagaaaggtcaatgctcaaattcgtaaagtagcagcaatgagtgaagatgaattgatgacagaagcgaagaacctaggagcaccgtatgaattattgcttcaaatcaaaaaagacggcaagctcccagttgttaactttgcagcgggaggcgttgcgacaccagcagatgctgcgttaatgatgcagcttggagcagacggtgtatttgttggatctggtatttttaaatcagacaatccagcgaaatttgcaaaagccattgttgaagcaacgactcacttcacagattaccgtctcattgcagaactttcaaaagagcttggaacagccatgaaaggaattgaaatctcaaatctactgccagaagagcgtatgcaagagcgtggctggtaattaagggagcggcaaacgaacatgctaacaattggtgtactagggcttcaaggagccgtgagagagcatattcaatcgattgaagcctgtggcgcagaagggaagatcatcaaacgagcagaagagctagcatctgttgacggtcttattattcctggtggagaaagtacgacgatgagaagactcatggatacgtaccaattcattgaaccgatcaaatcgttcgctgcagaagggaaaccgatcttcggaacatgtgccggtttgattatgctggcaacgcaaatagaagatcgagacgatgcccatcttggactgttacatgtatctgttgcacggaattcatttggcagacaggtagacagctttgaagcagatttagaagtaaaaggactggatgcgccatttacaggagtgttcatccgtgcgcctcatattatcagcgcagatgagagcgtagacatcatggccgaatatgatggcaggattgtgatggcgaaggaaaacaatatcttaggctgttcttttcatccagagctgacagacgaccaccggttaacacagctgtttgttgaaatggtgaagtcctataaaacgaagctcgctgtataaaacggttgaaaagagataaaacttatagtacattaaaatcacaatcaaagatcgaaaaagcgttgacgggaaatagtaagaagcccctctttctcagagagccgatggttggtgcgaatcggtgaaagatgcagtctgaatccatccttgagcgaaatgctgaaacacgaaaagtaagcatttacggtgataccgttacagaggaaagaggaaagcatgcttctgcatgttttcaatcagggtggcaacgcgagagctctcgtccctttcatgggatgagggctctttttatttttcgataaaaaaaggagtgttacacatgctggatattaaacaactgcgcacggactttgatcaaatcaaagaaaaattagcacaccgaggcgaagatttagcagattttgataagtttggtgagctggatcaaaaaagaagagaactaatcgggaaaacagaagaattaaagagccgaagaaatgaagtatcacagcaagtggctgttctaaaaagagaaaagaaagacgccgatcacattattcaagaaatgcgtgaggtaggagatgagattaagaagctggatgatgagctaagaacagtagaagaaagcttgcagcacatcttattctctattccgaatatccctcatgacactgtacccgttggggaaacagaagatgacaacgtggaagtgagaaaatggggcgaacagcctgcattctcatttgagccaaagccacattgggacgtagcggatgaactaaacattctcgattttgaacgtgcaggaaaagtcacaggaagccgtttcgttttttataaagggcttggcgcacgcttagagcgcgcactatacaactttatgctcgatttgcacgtagatgagtttggttttactgaagtgcttccaccttacatggtcaatagagcaagcatgacagggactggacagcttccaaaattcgaagaggatgcctttaaaatccgtgaagaagattatttcctcattccaacagctgaagtacctattaccaacatgcaccgtgatgaaattcttgaaggggaacagctgccaatcaattatgcagcattcagtgcttgctttagatcagaggctggatctgccggcagagatacacgcggacttatccgtcagcatcaatttaataaggtagagcttgtgaaatttgtaagacctgaagattcttatgaagaattagagaaactaacaaaccaagcagaaaaagtccttcagctattaaacctgccataccgtgtcatgagcatgtgtaccggagatttaggcttcacggctgcgaagaaatacgacatcgaagtatggattccgagccaagatacgtatcgtgaaatttcttcttgcagtaacttcgaagcgttccaagcaagacgtgcaaacattcgattccgtccagagcctaaagccaagccagaacatgtgcacacattaaatggatctggtttagcagtaggaagaaccgtggcggccattttagaaaactatcaacaagaggacggtactgtgattattcctgaagtactgcgtccttatatgggaaataaagaagtaattaaataagatgccgctatggcatcttatttctttttcccaaaagtcctacagttttcctaaatttagccgatagaaatactaaaagcttctaggaaagaaggaataaccttgaataggcttgactattatgttgaaatggctcaattagttaggaaagttctagatgaaagtatccttttcggcatcactgatacagagaaggtgctttgttactatccgtctaacacaatagattttggcatgaaggttggagacccattgaacccagaagaccaaaacgtggcgacgacattaagaggacaagaatatgacggtcatttaccagagtctttatatggttatgaaattgcagtaaaaggttacccgatttttgatgaaaatagaaaagtaattggctcttttttagtggcattttcacatcatcgtgaaaagaaactaagtggttatatggaacatattaatgatgtagcgaaagaacttcaaagtgggatcgagcaaattgctgcgcattcacaagagctggcagccacaagtttagaaataagcgaacaggcaggaagagcggaagagaaatccgcaaatattgaagaagtcgtcaaaaccattggcgggattgctagacaaaccaacttgctaggcctaaatgctgcaattgaagcagcaagagcaggtgagaatggaaaaggatttgctgtcgtagctgatgaagttcgtaaattatcagatggctcaaaggaagcggctgaaaccattaataccttcttaaaagagatccaagacagcattggcactttgtctgaaaacatctcacaaatcagcagctcaacaaatgaacaagccaaacaagtgacagactttacgaaaattatcgaatcattaaatgagtttaaagaagagatgaatcattttattgaagagattagacaggatacaaaatagatcaagagcagccgtcgatggctgcttttttatgggcagattctcatgccaaaataacttattgaaatttttttcgaaaagatgttgacttcaaataaatcgatatggtatattaattcttgtcgatacggaggaatacccaagtccggctgaagggatcggtcttgaaaaccgacaggggtgtcaaagcccgcgggggttcgaatccctcttcctccgccatattgattttttaccttagttgaattgaaacgcaagcataaaaattggaattgtcaaaccgctgcattcgcgaaatgcagcggttttttttattttgttttagagcgatttttttgtataacagaagctatttcatgaagaatgggctcaagtgagctttcatcatgaagtaagtcgtaatcttcaatgttaattttaatcactggacataaatcgaattgttcgatccattccgtgtatcgcgtgtacatttcctcccaataggctcgatccgtttgagtttccatctctctgccgcgttcctcaatacgatgtaaaatatgatctaaatccccgtgtaaatagataagaacatcagggtgagggaagtaaggtgtcatcaccatcgcatcgaatagactcgtatacgtttcataatctacttcagacatcgtacctttgtccgcatgcatttttgcgaaaatgcccgtgtcctcataaattgaacgatcttgcacatatcctccaccagattcaaaaatccgcttttgctccttaaaacgctcagcgaggaaataaacttgtaaatggaagctccatctttggaaatctgaataaaagggctctaagtatgggttatcatctactttttcaagagaggtttgaaagccgagcttgtccgctattgttttagtcatagttgattttccgacaccaacagtcccggcgattgtgatcactgcatcctttggtatttcgatattgttcatagcacttgctcctttatgttctgtacaatttgctggtaatcttgctgcgaggaaacgaagtctgtatgatctccttcaattgtaatgataggaagccctgggtcagtctgttttaaatgttcaatggccagctcataatcttcaatgagtgtttttaaataagccgggtcaatgtcttcttcaaaagagcgtcctctcatctgtattctttcaagtaaggtaggaaggctcgcttttatatagatgatggcatttggtttaggaagatcatctgttagcaggtgatagatctttctgtatttgtccatgtgcttttttgataatgttctttctgcaaatatcatatttttatagacatgataatcagtgacaatcggctgctgttgattcacataggtttcttgaagagattctaattgtttgaaccgattgcataaaaagaacatttcaagctgaaagctccattgttccatatcttcataaaatttatctaagaatggattttcttctacaatctcttttactaaaggaaattgaaattccttcgcaagcattgtagccaaagttgtttttccggctccaatcgggccttccactgcaataaaaggggcaggatacataggcgttctcctctatctataaagttgtcaaaccaatgtatattgtaccatacccctcccgagagatagagcgaacggattacgatgtcgttcttttttcaatattaaattgatctgataataagagccaattttgaggaaaggatagacctaatttccaataagcaattccgttcaagtttaactctttgatgaggttgaactttgcttgaattgatctagcatcttcgaaccatacctcatgctctttattattggcatctgtataacggaaataaggtgcttgtgctgtttcgtcatatagaatggaggcattattatttctagcaattgcaatcgcttgttggggactgacagctttagcaatcggaccgccttgaacgtaaggaagcgtccaatcatagccgtataagttctggcccataacaattttattagctggaataacggtcagtgcatattcaatgacttggcggacaggtccaatgggagagactgcttgcgcagggccgccgctgtatccccattcgtaggtcattaatacaacatgatcgacgatcttcccaatggcttcatagtcatgagcttcataccatttccccttttgctgactactggttttaggggcaagtgcaacagatattgtccatccttcttgatggaagcgggttgttgcctctcttaaaaattgaatgtaggcatctttatcagcgggacgtaaatattcaaaatcaaaatggatttcttttaattgatatttttttgcaacacgaacgatttcatttaaaaatgtggctttgacagattggttattcaaaagaatttgcccaagttcatcactgaatttatcattctctaggttagtcaccaccatggataaaacggttctgctctgagcggctatttgaggtagctgatctaacggtggttctttcagtgttccatctctttgcgcttgaaaactaaaggcgcctaaatgcgttaaatatggagaggcctctctagctgcttgttttaagttttcactgacttgatttcctcgtggttcaatgtaagcattcgaattaatgttccttttaggtctttgaggaatatagagcaagaagcgaataggaagtatcgcttcaggccgtattctattcacacgtgccaactcttccactgaaatttgaaatcgtcttccaatttgataaagtgtgtcattttgtttgacctcataaaattgtcctctaattggaatgacaattgtttgtccaatgacgagttgatttggtgtttcaatatcgttggtacggatgatttcattgactgttgttttaaaacgcatggcaatttcgtttaaagtatctcctcttttgacaacataaatttgaatagtcaacgccccctttgttattgctaacaatttatgagggttatggataaatcatgtttgattttcattcgtgatctctttagcagtggtgatttttgctagtagaacgttctccatcatcgttaaagcatattcgttgtctctattgtcatttgatgcgatacaatctttaggtacaattaagttgtattctcgcatgtatgcgtcatttgcagtgaacagaacgcaaatgtttcctgcaattccggtcaaaatgatgtcgtgtacacctaattcatttaagagtgtctctaatgcagttccatagaaggcagaatgcttcggtttaattaagaagtaatcatctttagatggtgccattctctctaaaataagggcgcttctttcgttcttgcatgtttccatcacagcttgaatatcagccttccagagaccatagtggtcgttgatatagatgatcggccaattttccttgaaagcatgatctttaagagctaaaatcttattggtcatttgctctgttttatcagcgagcacatgtcccatttcaaaatcaaaattattaatcatgtcgataataagcagtgccttttggtgcttttgcaaagtaagaccccctttaaaagattgtgctaatatgttaacctcaatatccttttaaaaaacatgaaaagagagccgtgctatgacgagagatgaacagtttatgcaagaagctatttctgaagccttaaaagcagaacaaataggagaagtaccaatcggtgccatcatcgttttagatgaccaaattgtgagccgtgctcataatttaagggaaacagagcagcgttcaattgcacatgcagaattacttgctattgatgaagcgtgtaaaacgactggaagctggcgtttagaagatgctgtactttatgtgacgcttgaaccatgccctatgtgtgcgggagcgattgtcctttctagagtgaaaaaggtcgttttcggtgcatacgatccaaaaggtggatgtgcaggtactttaatgaatttactggatgatgaacggttcaatcatcagtctgaagtcattggtggtgtacttgaaaatgagtgtggtgagctgttaagtcagttcttccgaaatctccgtcagcgaaagaaacaagctaaaagtaaatgaatggatgtcgtttgcaatttcgactataagaaggtatacttatgtctgcgtcactaacaatttaatattcattttgccgtgctaagcggggaggtagcggtgccctgtactcgcaatccgctctagcgaggccgaatcccttctcaaggttcgtttacttcaaggtctgccttaaataagtggtgttgacgtctgggtcctgcgcaatgggaattcatgaaccatgtcaggtccggaaggaagcagcattaagtgaaacctctcatgtgccgcagggttgcctgggccgagctaactgtttaagtaacgcttggggtagcgaatcgacagaaggtgcacggtaaatcaatattaaatgtaactcatctagttaatctaggtgagttttttgttgctgtttaaagaatagttcagctgctttttttatacaaatagtcaaaaaatcttttttgagtctttttgttttttattaatcacaatgggaactagtgttcttattggcgtggcagatcaattcgaaaatctagaaaacaggtttttgattcacagaaagtagaaaatctatagttgaaatcatcattttcgtttattagaaaataaaggtgtgcttttgaattgatcggtgcatcatgtataataaaaaagatgataaatggaggagggcgtatttgtgagttatcaagctttgtatcgagtgttcagacctcaagtttttgaggatgttgttggacaagaacacatcacaaaaacgttgcaaaatgcccttttgcagaagaagttttctcatgcttacttattttcaggtcctagaggaacaggtaaaacaagtgctgctaaaatctttgcgaaggcagtgaactgtgaaaagtcacctgtgagtgaaccttgtaatgaatgtgatgcctgtaaagggattacaaacggctcgatttcagatgtgatcgaaatagatgctgcctcaaacaacggcgtagatgaaatccgtgatatacgtgataaagtgaagtttgcaccttcggcggttacatataaggtttatattatagatgaagtacatatgctctctatcggggcgtttaatgcccttcttaaaacgttagaggagccgcccgctcattgtatctttattttggctaccacagagcctcataagattcctcttaccatcatatctcgttgtcagagatttgattttaaacgaattacgacaaaagatattgttggaagaatgcagaaaattgtagatgcagaaagcctaaatgtacaagagggctcgctcgagattatcgctagtgcagctgatggtggtatgcgtgatgcactaagcctcttagatcaagccatttcatttagtggtgagcaactgacaattgatgatgcgctgctcattacaggagctgtttctcagcaattcattagtcagctagccgaagcaatttttgatcaaaatattgccgtggcgttagataccttaaatgaattacttcagcaggggaaagatgctgctaaattaattgaggacatgattttttattttagagatatgctgctttataaaacagcaccagatttggaaggagtccttgaaaaggtaaaggtcgatgaaaatttcgtgacgctttcggatcgtgtgacacctcaatttctatatgaaacaattgaagtgctgaataaaagtcaccaagaaatgaaatggacgaatcatccgaggattttctttgaggtagctgttgttaagctatgtcagtcaacggctggaataccgcaagctcatgctaacgctgatttaacgacactaacggataaaatagacaggttggaacaggagctatctaggataagagctgagggtgtgccaatgtctcattctcatcatcctcaagaaaaaaaggaagcacctcgaccacaaacgagtaacaaaaatggataccgtgcacctgtcggccgaattcacgagattctaaaagaagcaaaacgtccagagttagaaaaaattaaaggcaaatggggagaactccttgcccacttgaaacagcagaataaggtgtctcacgctgcactattaacggacagtgaaccagttgctgctgctactcatgcctttgttttaaaattcaagtttgaaatacattgtaaaatggttgctgaagataaaagtggtgttcgaaccaaccttgagcagctattagagtctatgttaggtaaaagagtggaattagttggcgttcctgacgctcaatggggtaaaataagagaagaatttttaagagatcatcagccggatgaacaggcagatggtcaggggacttctgctgaagaagatccgttgattgcagaagctaagaagttagtaggaaccgatttaattgaaattaaagattaataaaaatgaaagagagtggtgttcatatgcgcggtggaatgggaaatatgcaaaaaatgatgaaacaaatgcaaaaaatgcaaaaggatatggctaaggctcaagaagagcttgcagaaaaagtccttgaaggtaccgcaggtggcggtatggtcactgtaaaagtaaatggacaaaaagaagttgtcgatgtagcaatcaatgaagaagttgttgatccagaagatatcgatatgcttcaagatcttgtacttgcagcaacaaacgacgcattgaaaaaagtggatgagttaacaaatgaaacaatgggtcaattcacaaaaggaatgaacatgccaggtttattctaggaggaataactgaagatgcaatatcctgaaccaatatcaaagctgattgacagctttatgaaattgccaggaatcggaccaaaaactgcggtccgtctggctttttttgttcttagtatgcaggaagatgtcgtactagatttcgcgaaggcgcttgttaacgcaaagcgtaatttaacttattgctcggtatgcggccatatcacagatcaagatccttgctatatttgtgaagatacaagaagagatcaatctgttatctgtgtagtgcaagatccaaaagatgtgatcgcaatggaaaagatgaaagaatacaacggcttatatcatgtgcttcatggtgccatttcgccgatggatggcattggcccagaggatattaaaattcctgacctgttaaaaagattgcaagacgatcaagtgacagaggtaatacttgcaaccaatccaaacattgaaggagaggctacagccatgtatatctctagattgttgaaaccatcaggaattaaactctctcgtattgctcacggactaccagtaggtggagatttagagtatgcggatgaagtcacactgtctaaagctctagagggcagacgtgagatgtaggaaggagaagtacggtacatgggttttcttcgcagaaaatcaattcgaaaagaattcgatgagaaattaattcaacagctttttaagcaaaaggaagaatggaacagacaaaaaaagcttgtcgcaaatagcgttgagccttcaccggacattctattcgaattaaagcttgctcaagcgaagtactttttctatctaagagaagcgaaaaagaggaatttacgtttaaacaactggagatagcaggtctattttatatagtcctctcatatgcttgtactattcttatgaagaggagatgagaggattatggaacctgttattgtgatcggatcaattttgctagctgtgctattgttgtttatgtcaggtgttcaagcgaaccccttcaaatggttagggctgatcggagttaagtttgtggcaggtgctctttttttattttgcctcaatctatttggtgagagtctaggattacatgtttctattaaccctgtaacaagtggaatcagtggtttattgggcatcccaggcgtagcagctttagtcgtaattgaaaaatttattatttaatgaaaaatattgttgactttgatcctgtatggtgataaattaatatacgtcgctgatgacgaagaaacgaaaaaacatgataacaaaaaagttgttgacattaacaatttaaatatggtatgatgttctagtcgcttctgaagcggtaacgtgacaacggtcaaagatgccagcgatcaagacgcgcttgccgcatatgtcatcacagatgaagaaacgactgacctaaaggaaagtctaaaacgcacgttgccagactatatggtgccttcatggattatcaagttagaccaactgccgatgacggcaaatggcaaagtcgatctaaaagcattgccagcacctgataaggaagccaatcaaacagcttacgaatccccaagagacgaagttgaaacgcttctatgtggcatttgggaagacgtgcttggcgtcagccaagtcggcattcacgatcacttcttcttccttggaggagattcaattaaaggcatccaaatggcaagcagactcacacaagcaggctggaagctcgatatgaaactgcttttccaatacccaacgattgcggagctgcgcccatatatcgaagaagcggaccaactgacagccgaccaatcacctgtcgaaggggaagtcattttcacaccgattcagcgctggttctttgaacggaactttacgaatcagcaccattggaaccaatcggttatgctccaagcgccaaatggcttggatgaaaccatcgttcagcaagtgttggagcagctcatgatccatcacgatgcgctgcgaatggtgtatccgtttgaagaaggacgcgtgatccagcgtcatcgaaaaatcgaagaaaacttggtaactattgatgtaatggaagtacgaggggaactgtcgcagcaaatccagcaggtagaaaagctggcaaatgaagtgcaagcgagtatatcgctagcggaaggacctttagtaaagccagccattttccgaacggatcaaggggatcatttactgctcgctgtacatcatcttgtcatcgatggtgtgtcatggcgtattttccttgaagattttatggctctttatgaacagtcgaagcgcggggaaatcctgacacttcctgaaaaaacacactctttccaagaatatgcccagaagctgacggaatacgcgatgtcagatgagttgctgtcggaaagagcttattggaaaaaggtgcttgcgcatcccgttacaccaattcaaaaggatcatgtgacagaggatcagaggatgcttcatacacagaccattcgttttacattgtctgaggaggaaacacgcagtctgctgacagatgtacatgaagcatatcaaacagacatcaatgatattttgctgacagcactcggattgtctatgaaagagtggacaggagaagacagacactttattcatcttgaaggacacggaagagagaacatcctccctgcggtcaatgtatcacggacgattggctggtttacaagtatgtatcctgtgttactggatatgtcgcatacagacgatctttcttatcagattaagcatttgaaagaggagctcaggcacattccgaacaagggaatcggctacggcatattaaaatatttaacccctgacaagatgaaggaagatatctcattcgatctcgcgccagatatcagcttcaactatcttggtcagtttgatgaacagatcagcggtgagttaagccgctcaacgtggcatccaggacaatcgctgagtcctgaatcagagaaacctcatgcacttgatattgttggtttcgtcgaacaagctatgctccatgtgacaatttcttatcatcatcttgaatttgaagaacgtacgatggaacaattcaaggaccttcttgaaaagaatgtgaaggcgctgatctcacattgtgtatcacaggaagaaacccagatgacccctagtgatgtaggggatgaagatctcacgatggacgaacttgaaaagctaatggatatattttaagcaaacgaagaggtggacatatgagcaagcagaagattcaaaaggtatatcctttaacacccatgcaggagggcatgctgtatcatgccatgctagaccctaattcctcctcttatttcacacagcttgagcttggaataagcggagagtttgatcacgctctttttgaaaaaagtctcaatgagctcatacggacatatgacattctccgtacagcctttgtttatcaacaattacaaaagcctcgtcaggttgtacttgctgaacgtcatctcgatgtgtatagagaggatctatcacatctgaatcatcaagagcagcaaatggtattggatcaatataaaaaacaagtgagaaagcaaggatttcacttaacaaatgatctgttattgaaggtcgctgtttttcaactcaatgaaacaaactggcatctgatttggagcaaccatcacatcatcatggatggctggtccatgggtgttttaatgaaaaaattgtttcattactatgaatcttttcggaacggtcgaacgccggatcgctcacaagggaagccttatgcagattatatccagtggcttggaaagcaaaataaacaagaagcggaaagctattggctaaagcgtctagatggagcggttcagcatcaagggctgctacagcaaaaagaagcgaatgggcaatacgatcatcaggaatggacgtttacatgggatgctcaaacggtacaagccattcaaaatgtagcaagacaatgccaagtgacagccccgaacctgtttcaggctgtctggtctgttcttttagccacctatcatgcaactgatgatgtcacattcggcaccgttgtatcgggcagacctccaagtgtatctggaattgagcgcatggcagggctgtttatcaatacgatacccgttcgagtgacattggatcagaagcagacgtttaaacagttgtttcaaacggttcagcagcatgcactagaagcggaaaactatgattttatgccgctttatgacattcagcagaagacaactgctggagggcagctctttgatcatttggttgggtttgagaactatcctttagatcaggagctgtctggtgacaccatgtctgcacgtcttggtttttccattgatgtaaaggacggatttgaacaaacgaattttgatctaaatgtccttgtgtatccaggtgaaacgtggacattgaaaatcaaatacaacgccatagcttttgaagaaaaggtcattgaaaacatatcaaaacatctgaccaatctcatgaagcaaatcaccaaaaaccctgatgtacgccttcatgacgtgacatgtatcacggaagaagagaagcgacagataaaagcgtggaatcagacggagcgagattatccgaagcatctgtctattcctgagctgctcaatgaacgtatgaaggcgcagcctgaccatctagcactagttgaaggcgaccgaacatttacgtacgaggagcttggacaagaaatccgtcgtttagctggcagtcttattgaaaaaggcgtacagcccggggatgctgtggcggtgtatatgaaccgatcagctgatgcggtaatcgccatcttagcagttctccacgtaggggcagcttatgtaccgattgacccttcccagcctgaggagagaatccgatggatgcttgaagatagcggcgcatccattttgcttcatgctgatagtccgccgtcagttgatgaacagatcagggctgtacatgtgacgagtaagcctcatcactcacacatggatgtatcaatcaggacgtctccatctcacttggcgtatatcatgtatacatcggggtcaactggacagccaaaaggagttcaaattgagcatcagcatattgtgagattggcttgctctcaggagaaattaggcttgaccaagtcggatcgtatggcacatacaggtgccgtcagctttgacgccattacctttgaaatctttaccacgctgctgggtggcgcgacactgtatcctgttgaccgcgatactttattggatattcatcgattcgaacgatttatccaaacacatcagatcacgacgctctttttaacgactggattatttaatcagctcgctcagcagcgaccgcaaatattcaaaggattaaccacattaattacaggcggtgacgtgattaatgtgaagagtgcggagctcgtgaaacagcatcatccagcacttgttttactgaatgcctatggcccaacagaaaatacaaccatctcgaccatttacgaagtaagaggagatgaaacgggtccgattccaattggtcagccgatcaatcattcgtcggcttatattttagatgatgatcaaagattgcagccaattggagcgccaggagagctgtatgttggcggagatggtgtcgcaagagggtatctccatcgtccagatttgaccaatcaagtattcttggcagatccttttaagccgtcaggccgtttgtatcgaacaggggatttggctcggtatggcgcagatggccagatcgaattcctcggacgtacagatgatcaagtgaaaattcgaggcttccgtattgagcttggtgaaattgaaacagtgcttcagcaaaaagcgggcatagatgatgcggttgtgcttgtccattcgttttccacagatgaaaaggaaatcacggcttactttacagggacaatgacagaagaagaagtgcgagatgtatttaatcaagagctgccagcttatatggtgccgcaccatgtgatgaaactgaatgcttttccgctcacatcgaacggcaaggtagatcgaaaagctttaccaaagccggacgaagcctatcaggagaaaaaggaaatcattccgcctgagacggagacagaaaaggcactcgctcaaatttgggaggagcttcttggaaaaacggtaggagcagatgaacatttcttcatggctggcgggcactctctcaaagcgatgatgatgtccgcgaagattcaagaggtgcttcagaaagaagtgccgattcaagtgatttttgagaagccgacgattcgttcattagcggcatatatcgatcaggatggtcaagaagaaatggggcatccgattttaccagcagagcaggcggacgagtatccggtatcaccagctcagcgccgtttatatattttgcagacactcgaaccagacagcacgaattatcatattccaatcgtcttaacactagaagggacactcgaatatcagcggctcaaatcagcattcgatcagttgatccaaacgcacgaaatcctaagaacgagttttcatatgaatggagaagacattgttcaaagagtgaatgattggacggcatttgatcttcccgttcatgatgtcaaggaagaagaggcggaagcatttctttctgaacagcaatctccatttgatttaactgctgcgcctttattacgagcccagttgttgaaggtcagtgaaaaccgtcatcttcttgtcttggaagcacatcatctcattacagatggcagctccatgaaaacgtttatacaagatttggcgaaggcctatgatggagaagctcttgcagaaagagtcattcattataaagattacgctgtctggcagttaagtgaagaagagacggagaaacagaaggagcatgaagcctattggctgaagcaattcgaaggagaattgccagtattagagctgccaactgattattcgcgtccagcggagcgtgatttttcaggagaacgattcatgtttggctgtgatcaagtgacgactcagcggattcatgacctgcttcagaaaacagatacgaccatgtacatgttcttgttatctgcttttcaagtgctgcttgccacctatagcgggcaggaagatatcatcgttggttcccctgttgcaggacggacacatcctgatatacaggacatgccggggatgtttatcaacaccgttgcgatgcgcggaaaaccagagcaaacgaaaacatttttacagcttcttgaagaaataaaagaaacaagtgttgacgcttttgctcatcaaagctatccgctcgaagagttaattgcacgccttccgctagatcgtgatacaacccgaagtccgctctttagcgtgtcatttaacatgcagaacatggaggttcccgtactaaagctcggcgatctgcacatttcgccttatgccattcagcatcattcagtcaaatttgacttgtctctagaagcatttgaacgagagggagcattaaagctgagctttgactatgcagcggcgttatttaaagaagagacggtccgcagattcggaactcatcttctagcgattattcgtgaagcggtccaacacccggagaaacagatcggcttgctccgtatccttgatcagcatgagcaaatagagcggttggagaaaaaagacgaagtgcaaacaaatcgtcatgagcctttccatgtccaattttcacgtcaggcaaaggaaacaccagatgccattgcggtgatggatgatcaacggaagctcacttaccgcgagctagaagacatgtcaaatgcgcttggcagtgaactaaagatacgaggcgtcgagaaagaaaagactgtagcgctgattcttgaccgctctgtctatgtcatcgtttcaatgcttggtgtgatgaaagcgggtggtgcatttgtaccaattgatccggccttccctgcggaacgtatcaattacacattagaagattcaggtgcacaagtgatcgtaacaaatgagtctcttgcagaggcctatcaacatcacaagtcgattcaagttgtgcaggttgaaaaagcagtacttcaaagccgcacgctagatttgccggaagcatcagccgatcaacttgcgtatgtgatttacacatctgggacaacaggaaaaccgaagggtgttcagctcacgcatcgtaatctatcacactacgtgaactggctgacaaatgaggtgacattgcaagaatgcgatcggacggcactgctttcttcttatgcatacgatcttggttacacaagcattttccctgtcttaaaggcaggaggaacactgtatgtgcctcgtgaagatgtgtatacagacccggttcgactcatgcgtttaattgatgaacaagagctgacttatatcaaaatgacaccatccttatttcatatgatagcagattcgaaggatcatgcatttaacgctttacgccttgtcatacttggaggggaaccaattgtctctgaggatgtggaaacatttatggagcagcatccatgtgtggctgtcatgaaccactacggcccgacagagacaaccattggggctgtgaccaagctgattacaaagcaagagctaggcacactcaaggatcgctctgtgatcggacagccaattgctcacacaagagcgctcgcactcaatcgtcagcaacgcctcgttccatatggtgcacctggagagctttatatatcaggggaaggtgtatcgagagggtatttgaatcagcttgaattaacggcagagcgttttctagaaaatccgtattatcccgaagagcggatgtatcgtacaggagatttggtcagacagcatgcaaatggagacattgagtttctcggaagaatagatgatcaggtgaaaatacgcgggtatcgtattgaaaagcaagaaattgagtatgccgcacgtgcacgattatccattccagaggtgtatgtcaaagtactttatatgtcccgtttaccagagcttgcactttattacacatcgcctgaaccaattggaacactgacgtttagagaaaagcttgcggagacactgccggattatatgatcccaacgtactttgtcaaagtcgaccacatcccgcttactcaaaacggaaaggtagatgcgaagtctctgccgcttccgcacgaggtgcatatgaatcgcgcggtgcatgtagcaccagaaacggcacttgagcagacactttgcgatatttggtcagaagtacttggggttgaacaaataggtgttcatgatcacttctttgaattgggaggtcattccctcaaaggcatggtgctcatatcgaaaatgcaagccaagctgaacaaacatgtgccgctcaaagtcctttttgaaaagccaacgatacgggcgatggcagcttatttagaagaagtgaattcctcggacatgacatccattcaaccggcggagaagcaagatttctatcctgtctcttctgctcaaaagcggatgtatgtattgcagcagctgcatccagaagcagtgacttaccatatgcctgccgtattgatgatggaaggcagtcttgatgtaaaacagctagaagaagcgctgcaggctttgatcgaacgacatgaatcattgcgtacagcctttgtagaaattgacggcgtacccgttcaaaaagtctatcgccgagtgccgtttacgttagaggtggttgaagtagagaacggtcatgagcaacctgtcatagacgcattcatcaccccattctcattacatcaagcaccattaatgagggcaaaggtggcgaagctttctgatgagaaatatgtgttcatgatggatatgcaccatatcatcgcagatggtgtcacacgcagtctgctcattcaagaattggcaaagctgtatgagaaaaagacgttaccaccagttcagctgcactacaaggattatgcggtatggcagcaggaagaaaagcagcaagcgctgcttgagaaacagcgtcagtattggctggagcaatacgcagagcctcctgaagatttggcactgccacttgattttccgcgtcctcatgtacagtcatttgaaggagaccgagtcgatagatggttatctcctgagaaggtgcagaccattaaagcactcatggctgataaaggtgtgagcatgaacatggtcatgcaaacggcatttgccattttcctttccaaattaaccgggcagacagatatcgtcataggcgctgttacagcgggacgtacgcatgcttcaatcgaacgggttccaggcatgtttgtgaatacactggctcttcgacatgaagtacagctcgaggaaacgacagcacaattgcttgaaaaaatgaaagatcgaagcctatcagcctatgaacatcaagaatttccgtttgaggaattggtggcacagttagatcttccgaaagacacgagccgcaatccattgtttagtgtcatgctgacaacggatgaccgtgacatgacgttaccgaatctaaatggactcaagctttcgcaaaaacagcaagagacagctcatgcaaaatttgatgtaacgctcggtgtatttgaagaacaagatcaagtgggcgtacgctttgagtatgcaacggcgctgtttaaaaagaagaccattcagcgttggagtcgatattttgaacaaatcatagacgagatgctggtgaagctaaatgaaccaatttcatcgctttcgatcttaaatgaagaggaaaaacaagagctgatcaatgaatggtcgggtcctgtactaaatgtaccgtcagatcaaacggttcatgcactgattgaggctaaggcatacgagacgcctcatcaaaaagcggcaaccttctgcggaacgagctggacgtatgaagagctgaacagccgggcaaatacagtcgcttcaagactcatctcaaacggcataaaacgaggtgaccgcgtcggcattctgacccgtccgtcccttgacatgacggcagtcgtccttggcgtcttgaagtcaggtgcggcattcgttccaattgatgcggattatccggatcagcgtattgcctatatgctggaagactgcggggcagaggttcttctgatgcaaaaaggactggctgcaccaacttccttcacaggtcatgttctattgatagaagatgccgtagaaggcgaagcacacgatgttcaggttcatatgaaaccaacagatctcgcctatatgatttacacgtctggaacaacaggacagccgaagggtgtcatggttgagcaccagtcccttgtgaatctggcgttctggcacaatgatgctttccaagtgaccaatgcggatcgaaccgctaaatatgccggcaatgttctctcaaaactagataacaatgttcaaacttcacattagaataaaggttaagtcctcgatctattagtatctgtcagctccacgtgtcaccacgcttccacctcagacctatcaacctgatcatctttcagggatcttacttccttgcggaatgggaaatctcatcttgaggggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttacattttaggaggcgaccgccccagtcaaactgcccacctgacactgtctccctgcccgataagggcagcgggttagaaggtcaatacagccagggtagtatcccaccgatgcctccaccgaagctagcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggcttctcggggctttaacaccctaagaagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactaaatttcgctcgccatcacagctcagccttcacgggaaacggatttgcctatttcccagcctaactgcttggacgcggatatccaataccgcgcttaccctatcctcctgcgtccccccattgctcaaatggtgaggaggtggtacaggaatatcaacctgttgtccatcgcctacgcctttcggcctcggcttaggtcccgactaaccctgagcggacgagccttcctcaggaaaccttaggcattcggtggacgggattctcacccgtctttcgctactcataccggcattctcacttctaagcgctccaccagtccttccggtctgacttcacagcacttagaacgctctcctaccactgttcgtaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcatcggcattcggagtttgactgaattcggtaacccggtaggggcccctagtccaatcagtgctctacctccgagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcatgcgccctattcagactcgctttcgctgcggctccgcatcttctgcttaaccttgcacgggatcgtaactcgccggttcattctacaaaaggcacgccatcaccctttaacgggctctgactacttgtaggcacacggtttcaggatctatttcactccccttccggggtgcttttcacctttccctcacggtactggttcactatcggtcactagggagtatttagccttgggagatggtcctcccggattccgacggaatttcacgtgttccgccgtactcaggatccactctggagagaacaacatttcagttacagggctgttaccttctttggcgggcctttccagacctcttcgcttatatcgttcctttgtaactccgtatagagtgtcctacaaccccaagaggcaagcctcttggtttgggctgttcccgtttcgctcgccgctactcagggaatcgcatttgctttctcttcctccgggtacttagatgtttcagttccccgggtatgccttctcatactctatgtattcaagtatggatactactccattacgagcagtgggtttccccattcggaaatctccggatcaaagcttgcttacagctccccgaagcatatcggtgttcgtcccgtccttcatcggctcctagtgccaaggcatccaccgtgcgccctttctaacttaaccatttcttactttagaaagaatcactatgtgtgatgaactttgcattgcattcaatgtgaatgtattacttattgttatctagttttcaaagaacaaggtcctactggcgctactggtgtaactggagatactggtcctactggggctactggcgcaactggtgatacaggtcctactggtgctactggtgtaactggcgatactggtccaacgggacctactggtgatactggcgcaactggtgatacaggtcctactggagttactggtgtaactggtgataccggtcctactggtgatactggtgtaaccggagataccggtcctactggagttactggtgcaactggagataccggacctactggagccactggtgcaactggagataccggacctactggtgatacaggtgctactggagttactggtgtaactggagataccggagctactggcacaactggagataccggtcctactggtgccactggtgtaactggagataccggacctactggagccactggtgtaactggtgatacaggtccaacgggacctactggagccactggtgcaaccggtgatacaggtcctactggggctactggcgcaactggagataccggatctactggagccactggtgtaactggtgatacaggtccaacgggacctactggagttactggtgtaaccggagatacaggtcctactggtgctactggtgatacgggacctactggagccactggtgtaactggagatactggtccaacgggacctactggtgtaactggagataccggtcctactggagccactggcgcaactggagatactggtcctactggtgccactggtgcaactggtgatacgggacctactggtgcaactggtgcaactggtgatacgggacctactggtgcaactggtgtaactggagataccggacctactggtgctactggtgccactggagataccggtccaacgggacctactggtgctactggtgatacaggtgctactggtgtaactggcgcaactggagatacaggtcctactggagttactggtgtaaccggagatacaggtcctactggtgcaactggcgcaactggggcaactggagatacaggtcctactggagttactggtgcaactggagataccggacctactggagctactggtgccactggagataccggacctactggcgctactggtgtaactggagatacaggtcctactggagttactggtgtaaccggagataccggtcctactggtgtaactggtgatacaggtccaacgggacctactggtgcaactggtgccactggagataccggtccaacgggacctactggtgcaactggtgatacaggtgctactggtgtaactggcgcaactggagatacaggtcctactggagttactggtgcaactggtgatgccggtcctactggagttactggtgtaactggagataccggacctactggagctactggcgcaactggagataccggacctactggtgctactggtgtaactggcgcaactggagatacgggacctactggagttactggtgcaactggagataccggacctactggagctactggtgtaactggagataccggacctactggaggcactggtgcaactggtgagtttgatcctggctcaggacgaacgctggcggcgtgcctaatacatgcaagtcgagcgaacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggtggggcagatgattggggtgaagtcgtaacaaggtagccgtatcggaaggtgcggctggatcacctcctttctaaggatatatggagcagctccagttacaccagtggcaccagtaggtccggtatcaccagttgcgccagtagctccggtatctccagttacaccagtaactccagtagcacctgtatcaccagtagcaccagtaggtccggtatctccagttgcaccagtatcaccagtagctccggtatctccagttacaccagtaactccagtaggtccggtatctccagttgcaccagtggctccagtaggtcccgttggaccagtatcgccagttacaccagtggctccagtaggtccggtatctccagttgcaccagtggctccagtaggtccggtatctccagttgcaccagtaactccagtaggaccggtatctccggttacaccagtaggaccggtatctccagttacaccagtaggaccggtatctccagttacaccagttgcaccagtaggtccggtatcaccagttgcgccagtatcaccagtaggtcccgttggaccagtatcgccagttacaccagtagcaccagtaggaccggtatctccagttgcgccagtagccccagtaggaccagtatctccagttacaccagtagcgccagtaggacctgtatctccggttacaccagtaactccagtaggaccggtatcaccagtaggtccggtatctccagttgcaccagtgcctccagtaggtccggtatcaccagttgcgccagtagcaccagtaggtccggtatctccagttacaccagtagcaccagtaggtccggtatctccagttgcaccagtaactccagtaggaccggtatcaccagttgcgccagtggctccagtaggacctgtatcaccagttacaccagtggctccagtaggtcccgttggacctgtatcaccagttacaccagtggctccagtaggaccggtatgacttcactgggaaaggtgccgataacattaaaagtttctacaaagagctcgccggaaatgtagatatgttcatcagcttcatcgataagcaaaaagcctttcatgaaggtgtttctgggacactagatgatacaaactttggcggcgacacctttgtagaagaacactttttagataacgctgtacatatgggcatcaaaaacgccaaaagcattgtaaaggatcaaaaaaaggcacttaaaaccatttttcaagacatcgacgacctcatttctctagaagtatttgatagccaaaactttgatgaaaagattgcagatgcggaagacgagcgaaaaaagacagtgaaagacctaagagagcttgatcaaaatataaaagatgaatatgctttgtcagaaacggagcagcaagctacaatggcattgtacgcagaaatgatgaatgcgacaaatgacggaaaagccatttcacctatgaattttgacaagaaagcgtatcataatagcgaaatctacaaggcaaaaagcgatattgagaagcaaactgccgaatatctcaatattaaacaagaacaacaggaagcccgcgaaatcgcaaaggaacaagaagcactcgccaaccgtccttggtatgaaaaagcacttgattatggcgggaatattgtgaatgaactaactggcgtgaacgatgcaaaacgcgccgcaacgggcgttgacccgatcacaggcgaagaacttaccgcaggacagcgcgtcgccgcaggcggcatggcagcagcgggatatatccctatcgtcggctgggcagggcgcattttcaaaggcggaaaagccgtctataaaacgtggagcctagcgggatcgaaccgctgacctcctgcgtgcaaggcaggcgctctcccagctgagctaaggccccataaagatggtcgggaagacaggattcgaacctgcgaccccttggtcccaaaccaagtgctctaccaagctgagctacttcccgatcttaatggcgcgcccgagaggagtcgaacccctaaccttttgatccgtagtcaaacgctctatccaattgagctacgggcgcttattttataatgccgagggccggacttgaaccggcacggtagtcacctaccgcaggattttaagtcctgtgtgtctgccaattccaccaccccggcgtggatggtataagcggaagacgggattcgaacccgcgacccccaccttggcaaggtggtgttctaccactgaactacttccgcattacaggattactttattttatttggcaatgcgggtgaagggacttgaacccccacgtcataaagacactagatcctaagtctagcgcgtctgccaattccgccacacccgcatgaaacatggtgagccatgaaggactcgaaccttcgaccctctgattaaaagtcagatgctctaccaactgagctaatggctcgctttaaaagcgacttgtctattttaccatatgaaagtggtgccggcaagaggacttgaacccccaacctactgattacaagtcagttgctctaccagttgagctacaccggctttatctatcctaacattatgtaagaataaatatggtggaggatgacgggctcgaaccgccgaccctctgcttgtaaggcagatgctctcccagctgagctaatcctccatattttgttgtcatttcgaatgtctctcgatccgacaagtagtattatataacgataagatattgtttgtaaagacttttttaaaataatttttgaattaattttaacgctgtttttttcatcttttcgttaaggcacctaaagaagtttaccacttgtctcatcattttaaaagtctttttttcatttttttatgtttttttgttaaaaagcgctctaataacgcttcattgatgtaaaatgacccttttcatgttttttatatgcttgttttattcaatctatcttctcatacaaatcatctagagaagggattcttttattattttatttttctgagaaatcattttcatataaaaatatcagtaaatgatgctgttctttactatcttcaatattaaagtgttactggaggtaacaagttagttgttgattctttcttgttcttacttagaacgggcgtaaaaataaactgaaggtgctctatgctctttggcaatactcagttatctatagtgtatctctaacagtcctctttatctgttggctgccaaagaaaatcttattggctgctgtctatgcttttggtcttcatcctaaacgaattgaacgacctacccacacaacagctgcgttgttcaatgaaaatacataaaagtgaacggaagaaaaaattagctggtcgatgaggcttgctacatcatcacttctcactttacaaagcaatttaatagaagtaatttttactgcttctttgacttccgaaagtgcaagaagctgcgcttcaatttctgacagctcaatccggaagccgcgaatgttgacctgatggtcttttctgccgagatagatcagctcgccatcctctgtccatttcactaaatcgcctgtcaggtacatacgctcacccgaataaaatggatctgggacaaagcttttctctgtttcctctggaagattccagtaccctcttgccagtcctttccccgcaatcacgagctcacccggtacgcctggcggcgagaggtcatataacgaacccataatgtaaaaacgggtattggcaatcgctgttccaattggaagcgtgccttgatctgggttgatgatcccgcttgtcgccacgactgtgttttctgttggaccatagttattcacgagttgataaggaacaggctttacctgttttagcttgtctccgcctgttagtaagtaacgcaaggaatgattgtccatcgacataaactgctcgcatagctgggtcggcaggaatgcaatggtgatattttcgtcattgaaatacgcattgagcttgatcatatcgagacgaatcgcttcatcaatgatgtgcagctctgcgccggcgatccatgtcgggaacatttcccaaatggaggcatcaaagccaaaggcaactggagatacaggtcctactggagccactggtgcaggcttagcaggaattgtagcggctgatcctgtagtcagccctaattaccaagtagggcaagtagtgacctttaatggcagtacgtatgtagtaaatactacaccaccgtcaggtacaccagatacttccccagactacacattactagctgcagcaggactaactggaaccaccggtgcaaccgggcctactggatccacaggaaccaccggtgcaaccgggcctactggatccacaggaaccactggtgcaactggggctactggatccacagggatcactggtgcaaccgggcctactggatccacagggatcactggtgcaaccgggcctactggatccacagggatcactggtgcaactggggctactggatccacagggatcactggtgcaactgggcctactggatccacagggatcactggtgcaactggggctactggatccacaggaaccactggtgcaactgggcctactggatccacagggatcactggtgcaactggggctactggatccacagggatcactggtgctccagttacaccagtaactccagtagcacctgtatcaccagtagcaccagtaggaccggtatctccagttgcaccagtatcaccagtaggtccggtatctccagttgcaccagtggctccagtaggtcccgttggaccagtatcgccagttacaccagtggctccagtaggtccggtatctccagttgcaccagtgggtccagtaggtccggtatctccagttgcaccagtaactccagtaggaccggtatctccagttgcgccagtaggaccggtatcaccagttacaccagtaactccagtaggacctgtatcaccagttgcgccagtatcaccagtaggtcccgttggaccagtatctccagttacaccagtaggacctgtatcaccggttgcaccagtggctccagtaggtcccgttggacctgtatcaccagttacaccagttgcaccagtaggaccggtatctccggttacaccagtaactccagtaggacctgtatctccagttgccccagtagccccagtaggacctgtatctccagttgccccagtggctccagtaggacctgtatctttttaaatatctcttgatttattttcaatacatagtataatatcttttgtcactaaattgtctggtgatgatggcgaagaggtcacacccgttcccataccgaacacggaagttaagctcttcagcgccgatggtagttgggggtctccccctgtgagagtaggacatcgccaggctttcttcattccgcagtagctcagtggtagagctatcggctgttaaccgatcggtcgtaggttcgaatcctacctgcggagccaatttggagagctgtccgagtggccgaaggagcacgattggaaatcgtgtagacggtaaccccgtctcaagggttcgaatcccttgctctccgccacaaatttacataataaagggcccgttggtcaagcggttaagacaccgccctttcacggcggtaacacgggttcgaatcccgtacgggtcaccatttatagaatatacaccagtattttttattcggaggattagctcagctgggagagcatctgccttacaagcagagggtcggcggttcgagcccgtcatcctccaccatatcttaccagttacaccagttacaccagtaactccagtaggaccggtatcaccagttgcgccagtggcaccagtaggtccggtatcaccggttgcaccagtggcaccagtaggtcccgttggacctgtatcaccagttacaccagtggcaccagtaggaccggtatctccagttacaccagtggcaccagtaggtccggtatctccggttacaccagtaactccagtaggtcccgttggacctgtatcaccagttgcaccagtggcaccagtaggacctgtatcaccagtggcaccagttgatccttctgcagccagtaatgtgtagtctggggaagtatctggtgtacctgacggtggtgcagtatttactacatacgtactgccattaaaggtcactacttgccctacttggtaagtaggactgactaccggatcaaacgtttcaattcctgttaatcctgcaccagtagccccagtaggaccggtctatgtaggaatctctcgatccgacaaagattattatatacaggttttcatcatttgtaaaggctatattaaaaaaattttatttcaattttcattacgtatttcttttaacaaatgaccattatttcttctattaaaacagcgtgatctaacgttcatcacttaaacttctccactctatattctctttaaaaacgggcaattccttcataaatattcgcttctcacattagataccatgtggtccgtattagaattatctactattatcaatacagagcttttctatcatctattaatctaactctttactggttatttcatagttaactggaatacccgatctcatttttaaagtgtttcacatgcctgtaaatgcgctagagtgttgaaacgttcatcaaacaagtgcaatcagcagcatattttctcaagaagcttatatcatcgcggggtggagcagttcggtagctcgtcgggctcataacccgaaggtcgcaggttcaaatcctgcccccgcaaccaaattattttatacaccaatagggagtgctcattgagtgcaaccaaaatggtccggtagttcagttggttagaatgcctgcctgtcacgcaggaggtcgcgggttcgagtcccgtccggaccgccatttttaaaatgaatacatggctcggtagctcagttggtagagcaacggactgaaaatccgtgtgtcggcggttcgattccgtcccgagccacggttttaaaaaatatggcggaggaagagggattcgaacccccgcgggctttgacacccctgtcggttttcaagaccgatcccttcagccggacttgggtattcctccgtatggatggtggaccttgtaggactcgaacctacgaccggacggttatgagccgtctgctctaaccaactgagctaaaggtcctttatagcggcggaggggatcgaacccccgacctcacgggtatgaaccgtacgctctagccagctgagctacaccgccatgatcaaaataatcttttaaaaaggtccggtatctccagttacaccagtgcctccagtaggtccggtatctccagttacaccagtagctccagtaggtccggtatctccagttgcaccagtaactccagtaggaccggtatcaccagttgcgccagttacaccagtagcaccagtaggtccggtatctccagttgcgccagtagctccagtaggaccggcatcaccagttgcaccagtaactccagtaggacctgtatctccagttgcgccagttacaccagtagcacctgtatcaccagtatcaccagtcgttggtggagcctagcgggatcgaaccgctgacctcctgcgtgcaaggcaggcgctctcccagctgagctaaggccccgatttaatggaagatggtgggcctgagtggactcgaaccaccgacctcacgcttatcaggcgtgcgctctaaccagctgagctacaggcccatctttcatatcgaagatatgatgttgtaggatcttttgtaagttccttcaaaactaaacaagacgaaaacgcacatccgaggtatgcaggatgcatatcacacatgcgttgctacacgatgtagcgaacttagcatgtgatcatttcctgcctcgtcagcgtttgactgactacctatgatatttcataggatttttttataaaaactcgaattaacaggtacgttttgtcttgtttagttttcaaagatcatcttcggtatctccggttacaccagtaactccagtaggaccggtatctccagtaggtccggtatcaccagttgcaccagtgcctccagtaggtccggtatcaccagttgcgccagtagcaccagtaggtccggtatctccagttacaccagtagctccagtaggtccggtatcaggtcccgttggaccggtatctccagtggcaccagtggcaccagttgccccagtggctccagtaggacctgtatctccagttgccccagtggctccagtaggtcccgtatcaccagtactggaggcactggtgcaactggtgataccggacctactggagatacaggtcctactggagttactggtgtaaccggagataccggtcctactggtgccactggcgcaactggctctccatcaggtttggtggcgatagcgaagaggtcacacccgttcccataccgaacacggaagttaagctcttcagcgccgatggtagttgggggtctccccctgtgagagt
